United States Patent
Koch et al.

(10) Patent No.: US 11,584,944 B2
(45) Date of Patent: Feb. 21, 2023

(54) DEGRADATION PATHWAY FOR PENTOSE AND HEXOSE SUGARS

(71) Applicant: Braskem S.A., Sao Paulo (BR)

(72) Inventors: Daniel Johannes Koch, Campinas (BR); Lucas Pederson Parizzi, Campinas (BR); Felipe Galzerani, Campinas (BR); Jean Marie Francois, Plaisance-du-Touch (FR); Sophie Lajus, Ayguesvives (FR)

(73) Assignee: BRASKEM S.A., Sao Paulo (BR)

( * ) Notice: Subject to any disclaimer, the term of this patent is extended or adjusted under 35 U.S.C. 154(b) by 167 days.

(21) Appl. No.: 16/796,426

(22) Filed: Feb. 20, 2020

(65) Prior Publication Data

US 2020/0283811 A1   Sep. 10, 2020

Related U.S. Application Data

(60) Provisional application No. 62/808,258, filed on Feb. 20, 2019.

(51) Int. Cl.

| | | |
|---|---|---|
| C12P 7/24 | (2006.01) | |
| C12N 9/88 | (2006.01) | |
| C12P 7/18 | (2006.01) | |
| C12P 7/42 | (2006.01) | |
| C12P 17/18 | (2006.01) | |
| C12N 1/20 | (2006.01) | |
| C12N 15/52 | (2006.01) | |
| C12P 5/02 | (2006.01) | |
| C12P 7/28 | (2006.01) | |
| C12P 17/02 | (2006.01) | |

(52) U.S. Cl.
CPC ............ *C12P 17/18* (2013.01); *C12N 1/20* (2013.01); *C12N 15/52* (2013.01); *C12P 5/026* (2013.01); *C12P 7/28* (2013.01); *C12P 17/02* (2013.01); *C12Y 101/01043* (2013.01); *C12Y 101/01301* (2013.01); *C12Y 102/01009* (2013.01); *C12Y 202/01002* (2013.01); *C12Y 207/01011* (2013.01); *C12Y 207/02003* (2013.01); *C12Y 301/01031* (2013.01); *C12Y 401/02022* (2013.01); *C12Y 501/03001* (2013.01); *C12Y 503/01006* (2013.01); *C12Y 504/02* (2013.01)

(58) Field of Classification Search
None
See application file for complete search history.

(56) References Cited

U.S. PATENT DOCUMENTS

2017/0260551 A1* 9/2017 Koch ............. C12Y 208/03008

FOREIGN PATENT DOCUMENTS

| WO | 2013066568 A1 | 5/2013 |
| WO | 2013126721 A1 | 8/2013 |
| WO | 2014153036 A1 | 9/2014 |
| WO | 2017156166 A1 | 9/2017 |
| WO | 2020006058 A2 | 1/2020 |

OTHER PUBLICATIONS

Barbas et al.,"Deoxyribose-5-phosphate Aldolase as a Synthetic Catalyst", J. Am. Chem. Soc. 112:2013-2014, 1990 (Year: 1990).*
Jennewein, S et al., "Directed evolution of an industrial biocatalyst: 2-deoxy-D-ribose 5-phosphate aldolase," Biotechnology Journal, vol. 1, No. (5), May 1, 2006 (May 1, 2006), pp. 537-548.
International Search Report and Written Opinion for Application No. PCT/BR2020/050053, dated May 26, 2020, 12 pages.
Julia Bramski et al., Probing the acetaldehyde-sensitivity of 2-deoxyribose-5-phosphate aldolase (DERA) leads to resistant variants, Journal of Biotechnology, vol. 258 (2017) pp. 56-58 (3 pages).

* cited by examiner

*Primary Examiner* — David Steadman
(74) *Attorney, Agent, or Firm* — Morgan, Lewis & Bockius LLP

(57) ABSTRACT

The present application relates to recombinant microorganisms useful in the biosynthesis of monoethylene glycol (MEG) or glycolic acid (GA), or MEG and one or more co-product, from one or more pentose and/or hexose sugars. Also provided are methods of producing MEG (or GA), or MEG (or GA) and one or more co-product, from one or more pentose and/or hexose sugars using the recombinant microorganisms, as well as compositions comprising the recombinant microorganisms and/or the products MEG (or GA), or MEG and one or more co-product.

17 Claims, 25 Drawing Sheets

Specification includes a Sequence Listing.

FIG. 8

CLUSTAL O(1.2.4) multiple sequence alignment

```
                                                                        C47 and C37
                                                                             ↓
E.coli          MTDLKASSLRALKLMDLTTLNDDDTDEKVIALCHQAKTPVGNTAAICIYPRFIPIARKTL    60
B.caldolyticus  -------NIAKMIDHTLLKPEATEQQIVQLCTEAKQ--YGFAAVCVNPTWVKTAAREL      49
                       . *:.*.*: ::.   ** . : .*    **:;: *  *

E.coli          KEQGTPEIRIATVTNFPHGNDDIDIALAETRAAIAYGADEVDVVFPYRALMAGNEQVGFD   120
B.caldolyticus  ---SGTDVRVCTVIGFPLGATTPETKAFETTNAIENGAREVDMVINIGALKSGQDELVER  106
                   ..*:*.:* ** .** . .  *:*.*** * :** ****:* * .**:*: **: .

E.coli          LVKACKEACAAANVLLKVIIETGELKDEALIRKASEISIKAGADFIKTSTGKVAVNATPE   180
B.caldolyticus  DIRAVVEA-AAGRALVKVIVETALLTDEEKVR-ACQLAVKAGADYVKTSTGFSGGGATVE   164
                 ::* .** ** ..:***::**.* .**.::*  *.: :****::***** . * **.*

E.coli          SARIMEVIRDMGVEKTVGFKPAGGVRTAEDAQKYLAIADELFGADWADARHYRFGASSL   240
B.caldolyticus  DVALMRKTV----GDRAGVKASGGVRDWKTAEAMINAGA------TRIGTSSG        207
                .. :*...     *:  *:. .****  . :** :*.*         * *:**
                                                    K201 and K181

E.coli          LASLLKALGHGDGKSASSY                               259 (SEQ ID NO: 256)
B.caldolyticus  VAIVTGGTGR---ADY                                  220 (SEQ ID NO: 300)
                :*:: . *:   *:
```

DEGRADATION PATHWAY FOR PENTOSE AND HEXOSE SUGARS

CROSS-REFERENCE TO RELATED APPLICATIONS

This application claims priority to U.S. Provisional Application No. 62/808,258 filed Feb. 20, 2019, entitled "DEGRADATION PATHWAY FOR PENTOSE AND HEXOSE SUGARS", the disclosures of which are incorporated by reference herein.

FIELD OF THE INVENTION

This application relates to recombinant microorganisms useful in the biosynthesis of monoethylene glycol or monoethylene glycol and one or more co-product from one or more pentose and/or hexose sugars. This application additionally relates to recombinant microorganisms useful in the biosynthesis of glycolic acid or glycolic acid and one or more co-product from one or more pentose and/or hexose sugars. The application further relates to methods of producing monoethylene glycol or monoethylene glycol and one or more co-product from one or more pentose and/or hexose sugars using the recombinant microorganisms, as well as methods of producing glycolic acid or glycolic acid and one or more co-product from one or more pentose and/or hexose sugars using the recombinant microorganisms. The application further relates to compositions comprising one or more of these compounds and/or the recombinant microorganisms.

STATEMENT REGARDING SEQUENCE LISTING

The Sequence Listing associated with this application is provided in text format in lieu of a paper copy, and is hereby incorporated by reference into the specification. The name of the text file containing the Sequence Listing is BRSK-007_02US_ST25.txt. The text file is about 641 KB, was created on Feb. 18, 2020, and is being submitted electronically via EFS-Web.

BACKGROUND

A large number of chemical compounds are currently derived from petrochemicals. Compounds such as monoethylene glycol (MEG), glycolic acid, acetone, isopropanol (IPA), propene, serine, glycine, monoethanolamine, and ethylenediamine are valuable as raw material in the production of products like polyethylene terephthalate (PET) resins (from MEG), plastic polypropylene (from propene), polyglycolic acid and other biocompatible copolymers (from glycolic acid) and polyurethane fibers (from ethylenediamine). Alkenes (such as ethylene, propylene, different butenes, and pentenes, for example) are used in the plastics industry, fuels, and in other areas of the chemical industry. For example, isobutene is a small, highly reactive molecule that is used extensively as a platform chemical to manufacture a wide variety of products including fuel additives, rubber and rubber additives, and specialty chemicals.

However, the compounds are currently produced from precursors that originate from fossil fuels, which contribute to climate change. To develop more environmentally friendly processes for the production of MEG, researchers have engineered microorganisms with biosynthetic pathways to produce MEG. However, these pathways are challenging to implement, with loss of product yield, redox balance and excess biomass formation being some major obstacles to overcome.

Thus there exists a need for improved biosynthesis pathways for the production of MEG and other chemical compounds useful in industrial and pharmaceutical applications.

SUMMARY OF THE DISCLOSURE

This disclosure allows the conversion of a variety of C5 and C6 sugars, without carbon loss, to broadly usable key intermediates glyceraldehyde-3-phosphate (G3P) and glycolaldehyde, relying mainly on natural, proven reactions, by introducing just one new reaction catalyzed by a pentose-phosphate aldolase.

In some embodiments, the enzyme reactions of the disclosure allow for high yield MEG (or glycolic acid), or MEG (or GA) and one or more coproducts produced from glucose, xylose or various other sugars than can enter into the pentose phosphate pathway. In other embodiments, the enzyme reactions of the disclosure allow for high yield MEG (or glycolic acid), or MEG (or GA) and co-products produced from a variety of sugar oligomers which can be readily broken down to the corresponding monomers. In further embodiments, the enzyme reactions of the disclosure allow for high yield MEG (or glycolic acid), or MEG (or GA) and co-products production from a mixture of C5 and/or C6 sugar monomers and/or oligomers.

In some embodiments, the present methods solve or reduce the following problems compared to other glucose based MEG (or glycolic acid) production methods: ATP shortage; large NADH excess; low overall product yield potential. In further embodiments, the present methods further allow utilization of D-glucose, D-xylose, and/or various other sugars or mixtures with the same high yield of MEG or glycolic acid compared to other glucose based MEG or glycolic acid production methods.

In some embodiments, the present methods solve the following challenges and problems compared to other D-xylose based MEG (or glycolic acid) production methods, as well as other D-xylose based MEG and co-product production methods: a process depending on xylose (availability/market limitations, high price or low purity, slower and less efficient uptake than D-glucose); glucose induced inhibition of D-xylose utilization. In further embodiments, the present methods further allow utilization of D-glucose, D-xylose, and/or various other sugars or mixtures with the same high yield of MEG or glycolic acid or MEG and one or more co-product compared to other D-xylose based MEG (or glycolic acid) production methods, as well as other D-xylose based MEG and co-product production methods.

In one aspect, the present disclosure provides a recombinant microorganism comprising one or more biochemical pathway that produces one or more products derived from D-glyceraldehyde-3-phosphate (G3P) and glycolaldehyde from one or more pentose and/or hexose sugars via a pentose-phosphate intermediate.

In some embodiments, the pentose-phosphate intermediate is D-ribose-5-phosphate, D-ribulose-5-phosphate or D-xylulose-5-phosphate and wherein the enzyme have D-ribose-5-phosphate, D-ribulose-5-phosphate or D-xylulose-5-phosphate aldolase activity.

In some embodiments, a ribulokinase enzyme catalyzes the phosphorylation of D-ribulose to D-ribulose-5-phosphate. In some embodiments, the ribulokinase enzyme is encoded by *E. coli* AraB. In some embodiments, the ribulokinase enzyme is encoded by a nucleic acid sequence having at least 70% sequence identity, at least 80% sequence identity, or at least 90% sequence identity to AraB from *E. coli* (SEQ ID NO: 288).

In some embodiments, a ribokinase enzyme catalyzes the phosphorylation of D-ribose to D-ribose-5-phosphate. In some embodiments, the ribokinase enzyme is encoded by *E. coli* rbsK. In some embodiments, the ribulokinase enzyme is encoded by a nucleic acid sequence having at least 70% sequence identity, at least 80% sequence identity, or at least 90% sequence identity to rbsK from *E. coli* (SEQ ID NO: 290).

In some embodiments, a xylulokinase enzyme catalyzes the phosphorylation of D-xylulose to D-xylulose-5-phosphate. In some embodiments, the ribokinase enzyme is encoded by *T. maritima* XuK. In some embodiments, the ribulokinase enzyme is encoded by a nucleic acid sequence having at least 70% sequence identity, at least 80% sequence identity, or at least 90% sequence identity to XuK from *T. maritima* (SEQ ID NO: 291).

In one embodiment, the recombinant microorganism co-produces monoethylene glycol (MEG) and one or more co-products. In another embodiment, the one or more co-products are selected from acetone, isopropanol, propene, L-serine, glycine, monoethanolamine (MEA), ethylenediamine, or a combination thereof. In yet a further embodiment, the one or more product is selected from monoethylene glycol (MEG) and glycolic acid (GA).

Therefore, in one embodiment, the application relates to a recombinant microorganism comprising one or more biochemical pathway comprising at least one enzyme having an activity that converts one or more pentose and/or hexose sugars in a lossless conversion to pentose-phosphate intermediate and comprising at least one enzyme having a pentose-phosphate aldolase activity that converts the pentose-phosphate intermediate to glycolaldehyde and D-glyceraldehyde-3-phosphage (G3P).

In one embodiment, the application relates to a recombinant microorganism comprising one or more biochemical pathway comprising at least one enzyme having an activity that converts one or more pentose and/or hexose sugars in a lossless conversion to D-ribose-5-phosphate intermediate and comprising at least one enzyme having a D-ribose-5-phosphate aldolase (DERA) activity that converts the D-ribose-5-phosphate intermediate to glycolaldehyde and D-glyceraldehyde-3-phosphage (G3P).

In some embodiments, the recombinant microorganism comprises expression of at least one enzyme having transketolase activity and expression of at least one enzyme having pentose-phosphate aldolase activity. In some embodiments, the recombinant microorganism comprises expression of at least one enzyme having transketolase activity and expression of at least one enzyme having D-ribose-5-phosphate aldolase (DERA) activity. In some embodiments, the enzyme having transketolase activity is encoded by an amino acid sequence having at least 70% sequence identity, at least 80% sequence identity, or at least 90% sequence identity to tktA from *E. coli*. In other embodiments, the enzyme having transketolase activity is tktA from *E. coli*. In some embodiments, the enzyme having transketolase activity is encoded by an amino acid sequence having at least 70% sequence identity at least 80% sequence identity, or at least 90% sequence identity to tktB from *E. coli*. In other embodiments, the enzyme having transketolase activity is tktB from *E. coli*. In another embodiment, the one or more nucleic acid molecules encoding the enzyme having transketolase activity comprises an amino acid sequence selected from the group consisting of SEQ ID NOs: 148 and 150. In some embodiments, the one or more nucleic acid molecules encoding the enzyme having transketolase activity is tktA, or homolog thereof. In some embodiments, the one or more nucleic acid molecules encoding the enzyme having transketolase activity is tktB, or homolog thereof. In a further embodiment, the one or more nucleic acid molecule encoding the enzyme having transketolase activity is encoded by a nucleic acid sequence selected from the group consisting of SEQ ID NOs: 147 and 149. In some embodiments, the enzyme having D-ribose-5-phosphate aldolase activity is encoded by an amino acid sequence having at least 70% sequence identity, at least 80% sequence identity, or at least 90% sequence identity to deoC from *E. coli*. In other embodiments, the enzyme having D-ribose-5-phosphate aldolase activity is deoC from *E. coli*.

In some embodiments the *B. caldolyticus* pentose-phosphate aldolase is encoded by a nucleic acid sequence having at least 70% sequence identity, at least 80% sequence identity, or at least 90% sequence identity to:

```
                                         (SEQ ID NO: 286)
ATGACGATGAATATCGCGAAAATGATCGATCATACGCTGCTCAAACCGGA

AGCGACAGAACAACAAATCGTGCAACTGTGCACGGAAGCAAAGCAATACG

GCTTTGCTGCCGTGTGCGTCAACCCAACGTGGGTGAAAACGGCGGCGCGC

GAGCTTTCCGGCACGGATGTCCGCGTCTGCACGGTCATCGGCTTTCCACT

TGGGGCAACGACGCCGGAAACAAAGGCGTTTGAAACAACGAACGCCATCG

AAAACGGCGCTCGCGAAGTCGACATGGTGATCAACATCGGTGCGTTAAAA

AGCGGGCAAGACGAGCTTGTCGAGCGCGACATTCGTGCGGTTGTCGAAGC

GGCGGCTGGCAGGGCGCTTGTCAAAGTGATCGTTGAAACGGCGCTTTTGA

CCGATGAGGAAAAAGTGCGCGCCTGCCAGCTCGCAGTGAAAGCCGGCGCT

GATTATGTGAAAACGTCGACCGGGTTTTCCGGCGGAGGTGCGACGGTGGA

GGATGTGGCGCTGATGCGGAAAACGGTCGGCGACAGAGCAGGCGTCAAAG

CATCAGGCGGCGTCCGTGACTGGAAAACCGCTGAGGCGATGATCAACGCC

GGCGCGACGCGCATCGGCACAAGCTCTGGGGTGGCGATCGTCACCGGCGG

GACGGGCCGCGCTGACTACTAA.
```

In some embodiments the *B. caldolyticus* pentose-phosphate aldolase is encoded by a cDNA optimized sequence comprising a nucleic acid sequence having at least 70% sequence identity, at least 80% sequence identity, or at least 90% sequence identity to:

```
                                         (SEQ ID NO: 287)
CCATGGCAAACATCGCGAAGATGATTGACCACACCCTGCTGAAACCG

GAGGCGACCGAACAGCAAATCGTTCAGCTGTGCACCGAGGCGAAACAATA

CGGCTTCGCGGCGGTGTGCGTTAACCCGACCTGGGTTAAGACCGCGGCGC

GTGAACTGAGCGGTACCGACGTGCGTGTTTGCACCGTGATTGGTTTCCCG

CTGGGTGCGACCACCCCGGAGACCAAAGCGTTTGAAACCACCAACGCGAT

TGAGAACGGCGCGCGTGAAGTTGATATGGTGATCAACATTGGCGCGCTGA

AGAGCGGTCAGGACGAGCTGGTTGAGCGTGATATTCGTGCGGTGGTTGAG

GCTGCGGCGGGTCGTGCGCTGGTGAAAGTTATTGTGGAAACCGCGCTGCT

GACCGACGAGGAAAAAGTGCGTGCGTGCCAACTGGCGGTTAAGGCGGGTG
```

-continued
```
CGGATTACGTGAAAACCAGCACCGGTTTTAGCGGTGGCGGTGCGACCGTT

GAGGATGTGGCGCTGATGCGTAAGACCGTTGGCGATCGTGCGGGTGTGAA

AGCGAGCGGCGGTGTTCGTGACTGGAAGACCGCGGAAGCGATGATCAACG

CGGGTGCGACCCGTATTGGTACCAGCAGCGGTGTTGCGATTGTGACCGGC

GGTACCGGTCGTGCGGATTATAAGCTT.
```

In some embodiments, the *E. coli* pentose-phosphate aldolase is an amino acid sequence having at least 70% sequence identity, at least 80% sequence identity, or at least 90% sequence identity to:

```
                                      (SEQ ID NO: 256)
MTDLKASSLRALKLMDLTTLNDDDTDEKVIALCHQAKTPVGNTAAICIYP

RFIPIARKTLKEQGTPEIRIATVTNFPHGNDDIDIALAETRAAIAYGADE

VDVVFPYRALMAGNEQVGFDLVKACKEACAAANVLLKVIIETGELKDEAL

IRKASEISIKAGADFIKTSTGKVAVNATPESARIMMEVIRDMGVEKTVGF

KPAGGVRTAEDAQKYLAIADELFGADWADARHYRFGASSLLASLLKALGH

GDGKSASSY.
```

In some embodiments, *B. caldolyticus* pentose-phosphate aldolase is an amino acid sequence having at least 70% sequence identity, at least 80% sequence identity, or at least 90% sequence identity to:

```
                                      (SEQ ID NO: 297)
MTMNIAKMIDHTLLKPEATEQQIVQLCTEAKQYGFAAVCVNPTWVKTAA

RELSGTDVRVCTVIGFPLGATTPETKAFETTNAIENGAREVDMVINIGAL

KSGQDELVERDIRAWEAAAGRALVKVIVETALLTDEEKVRACQLAVKAGA

DYVKTSTGFSGGGATVEDVALMRKTVGDRAGVKASGGVRDWKTAEAMINA

GATRIGTSSGVAIVTGGTGRADY
```

In some embodiments the *B. caldolyticus* pentose-phosphate aldolase comprises a mutation C37N mutation and is encoded by a nucleic acid sequence having at least 70% sequence identity, at least 80% sequence identity, or at least 90% sequence identity to:

```
                                      (SEQ ID NO: 286)
ATGACGATGAATATCGCGAAAATGATCGATCATACGCTGCTCAAACCGGA

AGCGACAGAACAACAAATCGTGCAACTGTGCACGGAAGCAAAGCAATACG

GCTTTGCTGCCGTGTGCGTCAACCCAACGTGGGTGAAAACGGCGGCGCGC

GAGCTTTCCGGCACGGATGTCCGCGTCTGCACGGTCATCGGCTTTCCACT

TGGGGCAACGACGCCGGAAACAAAGGCGTTTGAAACAACGAACGCCATCG

AAAACGGCGCTCGCGAAGTCGACATGGTGATCAACATCGGTGCGTTAAAA

AGCGGGCAAGACGAGCTTGTCGAGCGCGACATTCGTGCGGTTGTCGAAGC

GGCGGCTGGCAGGGCGCTTGTCAAAGTGATCGTTGAAACGGCGCTTTTGA

CCGATGAGGAAAAGTGCGCGCCTGCCAGCTCGCAGTGAAAGCCGGCGCT

GATTATGTGAAAACGTCGACCGGGTTTTCCGGCGGAGGTGCGACGGTGGA

GGATGTGGCGCTGATGCGGAAAACGGTCGGCGACAGAGCAGGCGTCAAAG
```

```
CATCAGGCGGCGTCCGTGACTGGAAAACCGCTGAGGCGATGATCAACGCC

GGCGCGACGCGCATCGGCACAAGCTCTGGGGTCGCGATCGTCACCGGCGG

GACGGGCCGCGCTGACTACTAA.
```

In some embodiments, *B. caldolyticus* pentose-phosphate aldolase comprises a mutation C37N mutation and is an amino acid sequence having at least 70% sequence identity, at least 80% sequence identity, or at least 90% sequence identity to:

```
                                      (SEQ ID NO: 298)
MTMNIAKMIDHTLLKPEATEQQIVQLCTEAKQYGFAAVNVNPTWVKTAAR

ELSGTDVRVCTVIGFPLGATTPETKAFETTNAIENGAREVDMVINIGALK

SGQDELVERDIRAVVEAAAGRALVKVIVETALLTDEEKVRACQLAVKAGA

DYVKTSTGFSGGGATVEDVALMRKTVGDRAGVKASGGVRDWKTAEAMINA

GATRIGTSSGVAIVTGGTGRADY
```

In some embodiments, the recombinant microorganism comprises expression of at least one enzyme having transaldolase activity. In some embodiments, the enzyme having transaldolase activity is encoded by an amino acid sequence having at least 70% sequence identity, at least 80% sequence identity, or at least 90% sequence identity to talA or talB from *E. coli*. In some embodiments, the enzyme having transaldolase activity is talA from *E. coli*. In other embodiments, the enzyme having transaldolase activity is talB from *E. coli*. In another embodiment, the one or more nucleic acid molecules encoding the enzyme having transaldolase activity comprises an amino acid sequence selected from the group consisting of SEQ ID NOs: 152 and 154. In a further embodiment, the one or more nucleic acid molecule encoding the enzyme having transaldolase activity is encoded by a nucleic acid sequence selected from the group consisting of SEQ ID NOs: 151 and 153.

In some embodiments, the recombinant microorganism comprises expression of at least one enzyme having ribulose-5-phosphate 3-epimerase activity. In some embodiments, the enzyme having ribulose-5-phosphate 3-epimerase activity is encoded by an amino acid sequence having at least 70% sequence identity, at least 80% sequence identity, or at least 90% sequence identity to rpe from *E. coli*. In other embodiments, the enzyme having ribulose-5-phosphate 3-epimerase activity is rpe from *E. coli*. In another embodiment, the one or more nucleic acid molecules encoding the enzyme having ribulose-5-phosphate 3-epimerase activity comprise an amino acid sequence set forth in SEQ ID NO: 158. In a further embodiment, the one or more nucleic acid molecule encoding the enzyme having ribulose-5-phosphate 3-epimerase activity is encoded by a nucleic acid sequence set forth in SEQ ID NO: 157.

In some embodiments, the recombinant microorganism comprises expression of at least one enzyme having ribose-5-phosphate isomerase activity. In some embodiments, the enzyme having ribose-5-phosphate isomerase activity is encoded by an amino acid sequence having at least 70% sequence identity, at least 80% sequence identity, or at least 90% sequence identity to rpiA from *E. coli*. In other embodiments, the enzyme having ribose-5-phosphate isomerase activity is rpiA from *E. coli*. In other embodiments, the enzyme having ribose-5-phosphate isomerase activity is encoded by an amino acid sequence having at least 70% sequence identity, at least 80% sequence identity, or at least 90% sequence identity to rpiB from *E. coli*. In other embodiments, the enzyme having ribose-5-phosphate isomerase activity is rpiB from *E. coli*. In another embodiment, the one or more nucleic acid molecules encoding enzyme having ribose-5-phosphate isomerase activity comprise an amino acid sequence set forth in SEQ ID NO: 156. In a further embodiment, the one or more nucleic acid molecule encoding the enzyme having ribose-5-phosphate isomerase activity is encoded by a nucleic acid sequence set forth in SEQ ID NO: 155.

In some embodiments, the recombinant microorganism comprising expression of at least one enzyme having an activity selected from a transketolase activity, a transaldolase activity, a ribulose-5-phosphate 3-epimerase activity, a ribose-5-phosphate isomerase activity and a D-ribose-5-phosphate aldolase activity, further comprises a deleted or diminished activity one or more endogenous enzymes selected from glyceraldehyde 3-phosphate dehydrogenase, phophoglycerate kinase and phosphoglycerte mutase. In some embodiments, the endogenous glyceraldehyde 3-phosphate dehydrogenase enzyme is gapA, the phosphoglycerate kinase is pgk and the phosphoglycerate mutase is gpmA or gpmM.

In some embodiments, the recombinant microorganism comprises expression of at least one enzyme having fructose-6-phosphate phosphoketolase activity. In some embodiments, an enzyme having fructose-6-phosphate phosphoketolase activity is encoded by an amino acid sequence having at least 70% sequence identity, at least 80% sequence identity, or at least 90% sequence identity to an enzyme having fructose-6-phosphate phosphoketolase activity selected from the group consisting of *Bifidobacterium dentium* BDP_1006, *Bifidobacterium lactis* xfp, *Lactobacillus paraplantarum* xpkA and *Bifidobacterium breve* xfp. In a preferred embodiment, an enzyme having fructose-6-phosphate phosphoketolase activity is selected from the group consisting of *Bifidobacterium dentium* BDP_1006, *Bifidobacterium lactis* xfp, *Lactobacillus paraplantarum* xpkA and *Bifidobacterium breve* xfp. In another embodiment, the one or more nucleic acid molecules encoding the enzyme having fructose-6-phosphate phosphoketolase activity comprise an amino acid sequence selected from the group consisting of SEQ ID NOs: 212, 214, 216 and 218. In a further embodiment, the one or more nucleic acid molecule encoding the enzyme having fructose-6-phosphate phosphoketolase activity is encoded by a nucleic acid sequence selected from the group consisting of SEQ ID NOs: 211, 213, 215 and 217.

In some embodiments, the recombinant microorganism comprises expression of at least one enzyme having phosphate acetyltransferase activity. In some embodiments, an enzyme having phosphate acetyltransferase activity is encoded by an amino acid sequence having at least 70% sequence identity, at least 80% sequence identity, or at least 90% sequence identity to an enzyme having phosphate acetyltransferase activity selected from *E. coli* pta and *Clostridium acetobutylicum* pta. In a preferred embodiment, an enzyme having phosphate acetyltransferase activity is selected from *E. coli* pta and *Clostridium acetobutylicum* pta. In another embodiment, the one or more nucleic acid molecules encoding the enzyme having phosphate acetyltransferase activity comprise an amino acid sequence selected from SEQ ID NOs: 220 and 222. In a further embodiment, the one or more nucleic acid molecule encoding the enzyme having phosphate acetyltransferase activity is encoded by a nucleic acid sequence selected from SEQ ID NOs: 219 and 221.

In some embodiments, the recombinant microorganism comprising expression of at least one enzyme having an activity selected from a fructose-6-phosphate phosphoketolase activity, a phosphate acetyltransferase activity, a transketolase activity, a transaldolase activity, a ribulose-5-phosphate 3-epimerase activity, a ribose-5-phosphate isomerase activity and a D-ribose-5-phosphate aldolase activity, further comprises a deleted or diminished activity in an endogenous 6-phosphofructokinase enzyme. In some embodiments, the endogenous 6-phosphofructokinase enzyme is pfkA and/or pfkB.

In some embodiments, the one or more pentose and/or hexose sugars comprise D-xylose and the recombinant microorganism further comprises expression of at least one enzyme having xylose isomerase activity and expression of at least one enzyme having xylulose 5-kinase activity. In some embodiments, the at least one enzyme having xylose isomerase activity is encoded by an amino acid sequence having at least 70% sequence identity, at least 80% sequence identity, or at least 90% sequence identity to xylA from *E. coli* or *Pyromyces* sp. In a preferred embodiment, an enzyme having xylose isomerase activity is selected from *E. coli* xylA and *Pyromyces* sp xylA. In yet another embodiment, the one or more nucleic acid molecules encoding the xylose isomerase comprises an amino acid sequence selected from SEQ ID NOs: 95 and 144. In a further embodiment, the one or more nucleic acid molecules encoding the xylose isomerase is encoded by a nucleic acid sequence selected from the group consisting of SEQ ID NOs: 93, 94 and 143. In some embodiments, the at least one enzyme having xylulose 5-kinase activity is encoded by an amino acid sequence having at least 70% sequence identity, at least 80% sequence identity, or at least 90% sequence identity to xylB from *E. coli*. In a preferred embodiment, an enzyme having xylulose 5-kinase activity is *E. coli* xylB. In another embodiment, the one or more nucleic acid molecules encoding the D-xylulose 5-kinase comprises an amino acid sequence set forth in SEQ ID NO: 146. In a further embodiment, the one or more nucleic acid molecules encoding the D-xylulose 5-kinase is encoded by a nucleic acid sequence set forth in SEQ ID NO: 145.

In some embodiments, the one or more pentose and/or hexose sugars comprise D-fructose and the recombinant microorganism further comprises expression of at least one enzyme having fructose 1,6-bisphosphatase activity. In one embodiment, the at least one enzyme having fructose 1,6-bisphosphatase activity is encoded by an amino acid sequence having at least 70% sequence identity, at least 80% sequence identity, or at least 90% sequence identity to fbp from *E. coli*. In a preferred embodiment, an enzyme having fructose 1,6-bisphosphatase activity is *E. coli* fbp. In some embodiments, the enzyme having fructose 1,6-bisphosphatase activity converts D-fructose 1,6-bisphosphate to D-fructose 6-phosphate. In other embodiments, D-fructose is converted to fructose 1,6-bisphoshate by endogenous enzymes in the recombinant microorganism.

In some embodiments of any of the recombinant microorganisms described above, the recombinant microorganism further comprises a deleted or diminished activity in one or more endogenous enzymes selected from glucose 6-phosphate-1-dehydrogenase, 6-phosphogluconolactonase, and 6-phosphogluconate dehydrogenase. In further embodiments, the glucose 6-phosphate-1-dehydrogenase is zwf, the 6-phosphogluconolactonase is pgl, and the 6-phosphogluconate dehydrogenase is gnd.

In some embodiments, the one or more pentose and/or hexose sugars are capable of being converted to one or more intermediate in the non-oxidative pentose phosphate pathway of the recombinant microorganism. In other embodiments, the one or more pentose and/or hexose sugars are comprised of monomers, oligomers, or a combination thereof.

In some embodiments, the expression of at least one enzyme having transketolase activity and/or fructose-6-phosphate phosphoketolase activity and the expression of at least one enzyme having D-ribose 5-phosphate aldolase activity enables a lossless conversion of one or more pentose and/or hexose sugars to D-ribose-5-phosphate intermediate and the subsequent conversion of D-ribose-5-phosphate to G3P and glycolaldehyde.

In some embodiments, the recombinant microorganism produces MEG or glycolic acid (GA) through the conversion of glycolaldehyde in a C2 pathway and through the conversion of G3P in one or more C3 pathways. In some embodiments, MEG is produced by the reduction of glycolaldehyde by an enzyme having glycolaldehyde reductase activity in a C2 pathway. In other embodiments, GA is produced by the oxidation of glycolaldehyde by an enzyme having glycolaldehyde dehydrogenase activity in a C2 pathway.

In some embodiments, the at least one enzyme for the production of MEG or GA are selected from at least one enzyme having an activity selected from a 3-phosphoglycerate dehydrogenase activity, a phosphoserine aminotransferase activity, a serine transaminase activity, a 3-phosphohydroxypyruvate phosphatase activity, a phosphoserine phosphatase activity, a hydroxypyruvate decarboxylase activity, a 3-phosphohydroxypyruvate reductase activity, a glycolaldehyde reductase activity, a glycolaldehyde dehydrogenase activity, a serine oxidoreductase (deaminating) or serine-pyruvate aminotransferase activity, a serine decarboxylase activity, an ethanolamine aminotransferase or ethanolamine oxidoreductase (deaminating) activity, a glycerate decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, and a glyoxylate reductase activity.

In some embodiments, the recombinant microorganism produces MEG through the conversion of glycolaldehyde in a C2 pathway and produces one or more co-product through the conversion of G3P in one or more C3 pathways. In other embodiments, the one or more co-product is selected from acetone, isopropanol, propene, isobutene and one or more serine pathway compounds. In some preferred embodiments, the one or more serine pathway compounds is selected from serine, glycine, monoethanolamine (MEA) and ethylenediamine (EDA).

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, and an acetoacetate decarboxylase activity, and the one or more co-product comprises acetone.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, and a secondary alcohol dehydrogenase activity, and the one or more co-product comprises isopropanol.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a secondary alcohol dehydrogenase activity, and a dehydratase activity, and the one or more co-product comprises propene.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a 3-hydroxyisovalerate (3HIV) synthase activity, a hydroxymethylglutaryl-CoA synthase activity, a methylglutaconyl-CoA hydratase activity, a methylcrotonyl-CoA carboxylase activity, a methylcrotonyl-CoA hydratase activity, a 3-hydroxyisovaleryl-CoA thioesterase activity, a 3HIV kinase activity, a 3HIV-3-phosphate decarboxylase activity, and a 3HIV decarboxylase activity, and the one or more co-product comprises isobutene.

In some embodiments, the at least one enzyme for the production of one or more co-product through the conversion of G3P in one or more C3 pathways are selected from at least one enzyme having an activity selected from a 3-phosphoglycerate dehydrogenase activity, a phosphoserine aminotransferase activity, a 3-phosphohydroxypyruvate phosphatase activity, a phosphoserine phosphatase activity, a serine oxidoreductase (deaminating) or serine-pyruvate aminotransferase activity, a hydroxypyruvate reductase activity, a 3-phosphoglycerate phosphatase activity, a 2-phosphoglycerate phosphatase activity, a glycerate 3-kinase activity, and a glycerate 2-kinase activity, and the one or more co-product comprises L-serine.

In some embodiments, the at least one enzyme for the production of one or more co-product through the conversion of G3P in one or more C3 pathways are selected from at least one enzyme having an activity selected from a serine hydroxymethyltransferase activity, a transferase activity, a formaldehyde dehydrogenase activity, a formate dehydrogenase activity, an activity associated with glycine cleavage system, a 3-phosphoglycerate dehydrogenase activity, a phosphoserine aminotransferase activity, a 3-phosphohydroxypyruvate phosphatase activity, a phosphoserine phosphatase activity, a serine transaminase activity, a hydroxypyruvate decarboxylase activity, a serine oxidoreductase (deaminating) activity, a serine decarboxylase activity, an ethanolamine aminotransferase or ethanolamine oxidoreductase (deaminating) activity, a hydroxypyruvate reductase activity, a 3-phosphoglycerate phosphatase activity, a 2-phosphoglycerate phosphatase activity, a glycerate 3-kinase activity, a glycerate 2-kinase activity, a glycolaldehyde dehydrogenase activity, a glycolate dehydrogenase activity, an alanine-glyoxylate aminotransferase activity, an alanine transaminase activity, an NAD(P)H dependent glutamate dehydrogenase activity, and the one or more co-product comprises glycine. In another embodiment, the activity associated with glycine cleavage system comprise an enzyme or protein selected from a glycine decarboxylase (P protein), an aminomethyltransferase (T protein), a dihydrolipoamide dehydrogenase (L protein), and an H protein.

In some embodiments, the at least one enzyme for the production of one or more co-product through the conversion of G3P in one or more C3 pathways are selected from at least one enzyme having an activity selected from a 3-phosphoglycerate dehydrogenase activity, a 3-phosphoserine aminotransferase activity, a 3-phosphohydroxypyruvate phosphatase activity, a phosphoserine phosphatase activity, a transaminase activity, a hydroxypyruvate decarboxylase activity, a serine oxidoreductase (deaminating) or serine-pyruvate aminotransferase activity, a serine decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, an acetaldehyde dehydrogenase activity, and an ethanolamine ammonia lyase activity, and the one or more co-product comprises monoethanolamine (MEA).

In some embodiments, the at least one enzyme for the production of one or more co-product through the conversion of G3P in one or more C3 pathways are selected from at least one enzyme having an activity selected from a serine dehydrogenase activity, a 2-aminomalonate semialdehyde decarboxylase activity, an aminoacetaldehyde transaminase activity, a 2-aminomalonate semialdehyde transaminase activity, a 2,3-diaminopropanoate decarboxylase activity, a serine decarboxylase activity, an ethanolamine dehydrogenase activity, a serine hydroxymethyltransferase activity, an aldehyde oxidase activity, an N-acetyl transferase or O-acetyl transferase activity, an N-acetylserine dehydrogenase activity, a transaminase activity, a deacetylase activity, a serine aminase activity, and a 2,3-diaminopropanoate ammonia lyase activity, and the one or more co-product comprises ethylenediamine (EDA).

In some embodiments of any of the recombinant microorganisms described above, the recombinant microorganism further comprises one or more modifications to diminish or delete activity in a glycolaldehyde reductase, a glycolaldehyde dehydrogenase, a lactate dehydrogenase, or combination thereof.

In one embodiment, at least a portion of the excess NADH produced in the C3 pathway is used as a source of reducing equivalents in the C2 pathway. In another embodiment, at least a portion of the excess NADH produced in the C3 pathway is used to produce ATP.

In one embodiment, excess biomass formation is minimized and production MEG (or glycolic acid), or MEG (or GA) and one or more co-products is maximized.

In another aspect, the application provides for a method of producing one or more products derived from glyceraldehyde-3-phosphate (G3P) and glycolaldehyde using a recombinant microorganism of any of the above embodiments, wherein the method comprises cultivating the recombinant microorganism in a culture medium containing one or more pentose and/or hexose sugars providing a carbon source until the one or more products derived from glyceraldehyde-3-phosphate (G3P) and glycolaldehyde are produced. In some embodiments, the recombinant microorganism co-produces monoethylene glycol (MEG) and one or more co-products. In further embodiments, the one or more co-products are selected from acetone, isopropanol, propene, L-serine, glycine, monoethanolamine (MEA), ethylenediamine (EDA), or a combination thereof. In yet further embodiments, the one or more product is selected from monoethylene glycol (MEG) and glycolic acid (GA).

In yet another aspect, the application provides for a method of producing a recombinant microorganism that produces or accumulates one or more products derived from glyceraldehyde-3-phosphate (G3P) and glycolaldehyde from one or more pentose and/or hexose sugars via a D-ribose-5-phosphate intermediate, comprising: introducing into or expressing in the recombinant microorganism one or more enzyme for the conversion of the one or more pentose and/or hexose sugars to the D-ribose-5-phosphate intermediate; introducing into or expressing in the recombinant microorganism one or more enzyme for the conversion of the D-ribose-5-phosphate intermediate to G3P and glycolaldehyde; introducing into or expressing in the recombinant microorganism one or more enzyme for the production of the one or more products from glycolaldehyde in a C2 pathway; and introducing into or expressing in the recombinant microorganism one or more enzymes for the production of the one or more products from G3P in one or more C3 pathways; and culturing the recombinant microorganism in a culture medium containing the one or more pentose and/or hexose sugars to produce or accumulate the one or more products. In some embodiments, the recombinant microorganism co-produces monoethylene glycol (MEG) and one or more co-products. In further embodiments, the one or more co-products are selected from acetone, isopropanol, propene, L-serine, glycine, monoethanolamine (MEA), ethylenediamine (EDA), or a combination thereof. In yet further embodiments, the one or more product is selected from monoethylene glycol (MEG) and glycolic acid (GA).

BRIEF DESCRIPTION OF DRAWINGS

Illustrative embodiments of the disclosure are illustrated in the drawings, in which:

FIG. 8 is a depiction of the alignment of DERA from E. coli and B. caldolyticus with mutations highlighted.

DETAILED DESCRIPTION

Definitions

Figure 1:
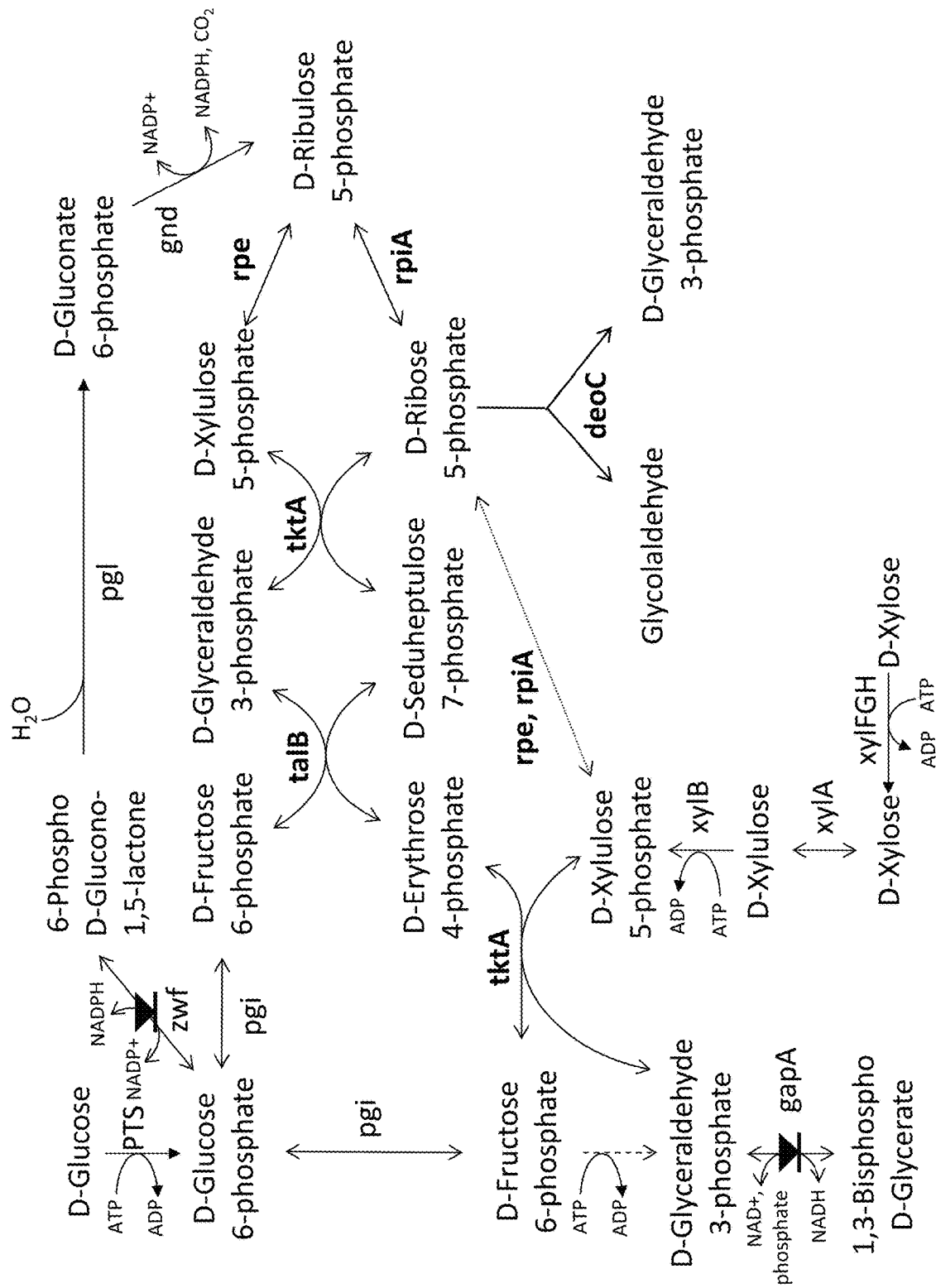
FIG. 1 illustrates a degradation pathway for pentoses or hexoses. The symbol  means enzymes to be potentially down regulated or inactivated/abolished, ie. respective gene potentially attenuated or deleted.

The following definitions and abbreviations are to be used for the interpretation of the disclosure.

As used herein and in the appended claims, the singular forms "a," "an," and "the" include plural referents unless the context clearly dictates otherwise. Thus, for example, reference to "an enzyme" includes a plurality of such enzymes and reference to "the microorganism" includes reference to one or more microorganisms, and so forth.

As used herein, the terms "comprises," "comprising," "includes," "including," "has," "having," "contains," "containing," or any other variation thereof, are intended to cover a non-exclusive inclusion. A composition, mixture, process, method, article, or apparatus that comprises a list of elements is not necessarily limited to only those elements but may include other elements not expressly listed or inherent to such composition, mixture, process, method, article, or apparatus. Further, unless expressly stated to the contrary, "or" refers to an inclusive "or" and not to an exclusive "or."

The terms "about" and "around," as used herein to modify a numerical value, indicate a close range surrounding that explicit value. If "X" were the value, "about X" or "around X" would indicate a value from 0.9X to 1.1X, or, in some embodiments, a value from 0.95X to 1.05X. Any reference to "about X" or "around X" specifically indicates at least the values X, 0.95X, 0.96X, 0.97X, 0.98X, 0.99X, 1.01X, 1.02X, 1.03X, 1.04X, and 1.05X. Thus, "about X" and "around X" are intended to teach and provide written description support for a claim limitation of, e.g., "0.98X."

As used herein, the terms "microbial," "microbial organism," and "microorganism" include any organism that exists as a microscopic cell that is included within the domains of archaea, bacteria or eukarya, the latter including yeast and filamentous fungi, protozoa, algae, or higher Protista. Therefore, the term is intended to encompass prokaryotic or eukaryotic cells or organisms having a microscopic size and includes bacteria, archaea, and eubacteria of all species as well as eukaryotic microorganisms such as yeast and fungi. Also included are cell cultures of any species that can be cultured for the production of a chemical.

As described herein, in some embodiments, the recombinant microorganisms are prokaryotic microorganism. In some embodiments, the prokaryotic microorganisms are bacteria. "Bacteria", or "eubacteria", refers to a domain of prokaryotic organisms. Bacteria include at least eleven distinct groups as follows: (1) Gram-positive (gram+) bacteria, of which there are two major subdivisions: (1) high G+C group (*Actinomycetes, Mycobacteria, Micrococcus*, others) (2) low G+C group (*Bacillus, Clostridia, Lactobacillus, Staphylococci, Streptococci, Mycoplasmas*); (2) Proteobacteria, e.g., Purple photosynthetic+non-photosynthetic Gram-negative bacteria (includes most "common" Gram-negative bacteria); (3) Cyanobacteria, e.g., oxygenic phototrophs; (4) Spirochetes and related species; (5) *Planctomyces*; (6) *Bacteroides*, Flavobacteria; (7) *Chlamydia*; (8) Green sulfur bacteria; (9) Green non-sulfur bacteria (also anaerobic phototrophs); (10) Radioresistant micrococci and relatives; (11) *Thermotoga* and *Thermosipho* thermophiles.

"Gram-negative bacteria" include cocci, nonenteric rods, and enteric rods. The genera of Gram-negative bacteria include, for example, *Neisseria, Spirillum, Pasteurella, Brucella, Yersinia, Francisella, Haemophilus, Bordetella, Escherichia, Salmonella, Shigella, Klebsiella, Proteus, Vibrio, Pseudomonas, Bacteroides, Acetobacter, Aerobacter, Agrobacterium, Azotobacter, Spirilla, Serratia, Vibrio, Rhizobium, Chlamydia, Rickettsia, Treponema*, and *Fusobacterium*.

"Gram positive bacteria" include cocci, nonsporulating rods, and sporulating rods. The genera of gram positive bacteria include, for example, *Actinomyces, Bacillus, Clostridium, Corynebacterium, Erysipelothrix, Lactobacillus, Listeria, Mycobacterium, Myxococcus, Nocardia, Staphylococcus, Streptococcus*, and *Streptomyces*.

The term "recombinant microorganism" and "recombinant host cell" are used interchangeably herein and refer to microorganisms that have been genetically modified to express or to overexpress endogenous enzymes, to express heterologous enzymes, such as those included in a vector, in an integration construct, or which have an alteration in expression of an endogenous gene. By "alteration" it is meant that the expression of the gene, or level of a RNA molecule or equivalent RNA molecules encoding one or more polypeptides or polypeptide subunits, or activity of one or more polypeptides or polypeptide subunits is up regulated or down regulated, such that expression, level, or activity is greater than or less than that observed in the absence of the alteration. For example, the term "alter" can mean "inhibit," but the use of the word "alter" is not limited to this definition. It is understood that the terms "recombinant microorganism" and "recombinant host cell" refer not only to the particular recombinant microorganism but to the progeny or potential progeny of such a microorganism. Because certain modifications may occur in succeeding generations due to either mutation or environmental influences, such progeny may not, in fact, be identical to the parent cell, but are still included within the scope of the term as used herein.

The term "expression" with respect to a gene sequence refers to transcription of the gene and, as appropriate, translation of the resulting mRNA transcript to a protein. Thus, as will be clear from the context, expression of a protein results from transcription and translation of the open reading frame sequence. The level of expression of a desired product in a host cell may be determined on the basis of either the amount of corresponding mRNA that is present in the cell, or the amount of the desired product encoded by the selected sequence. For example, mRNA transcribed from a selected sequence can be quantitated by qRT-PCR or by Northern hybridization (see Sambrook et al., Molecular Cloning: A Laboratory Manual, Cold Spring Harbor Laboratory Press (1989)). Protein encoded by a selected sequence can be quantitated by various methods, e.g., by ELISA, by assaying for the biological activity of the protein, or by employing assays that are independent of such activity, such as western blotting or radioimmunoassay, using antibodies that recognize and bind the protein. See Sambrook et al., 1989, supra.

The term "polynucleotide" is used herein interchangeably with the term "nucleic acid" and refers to an organic polymer composed of two or more monomers including nucleotides, nucleosides or analogs thereof, including but not limited to single stranded or double stranded, sense or antisense deoxyribonucleic acid (DNA) of any length and, where appropriate, single stranded or double stranded, sense or antisense ribonucleic acid (RNA) of any length, including siRNA. The term "nucleotide" refers to any of several compounds that consist of a ribose or deoxyribose sugar joined to a purine or a pyrimidine base and to a phosphate group, and that are the basic structural units of nucleic acids. The term "nucleoside" refers to a compound (as guanosine or adenosine) that consists of a purine or pyrimidine base combined with deoxyribose or ribose and is found especially in nucleic acids. The term "nucleotide analog" or "nucleoside analog" refers, respectively, to a nucleotide or nucleoside in which one or more individual atoms have been replaced with a different atom or with a different functional group. Accordingly, the term polynucleotide includes nucleic acids of any length, DNA, RNA, analogs and fragments thereof. A polynucleotide of three or more nucleotides is also called nucleotidic oligomer or oligonucleotide.

It is understood that the polynucleotides described herein include "genes" and that the nucleic acid molecules described herein include "vectors" or "plasmids." Accordingly, the term "gene", also called a "structural gene" refers to a polynucleotide that codes for a particular sequence of amino acids, which comprise all or part of one or more proteins or enzymes, and may include regulatory (non-transcribed) DNA sequences, such as promoter sequences, which determine for example the conditions under which the gene is expressed. The transcribed region of the gene may include untranslated regions, including introns, 5'-untranslated region (UTR), and 3'-UTR, as well as the coding sequence.

The term "enzyme" as used herein refers to any substance that catalyzes or promotes one or more chemical or biochemical reactions, which usually includes enzymes totally or partially composed of a polypeptide or polypeptides, but can include enzymes composed of a different molecule including polynucleotides.

As used herein, the term "non-naturally occurring," when used in reference to a microorganism organism or enzyme activity of the disclosure, is intended to mean that the microorganism organism or enzyme has at least one genetic alteration not normally found in a naturally occurring strain of the referenced species, including wild-type strains of the referenced species. Genetic alterations include, for example, modifications introducing expressible nucleic acids encoding metabolic polypeptides, other nucleic acid additions, nucleic acid deletions and/or other functional disruption of the microorganism's genetic material. Such modifications include, for example, coding regions and functional fragments thereof, for heterologous, homologous, or both heterologous and homologous polypeptides for the referenced species. Additional modifications include, for example, non-coding regulatory regions in which the modifications alter expression of a gene or operon. Exemplary non-naturally occurring microorganism or enzyme activity includes the hydroxylation activity described above.

The term "exogenous" as used herein with reference to various molecules, e.g., polynucleotides, polypeptides, enzymes, etc., refers to molecules that are not normally or naturally found in and/or produced by a given yeast, bacterium, organism, microorganism, or cell in nature.

On the other hand, the term "endogenous" or "native" as used herein with reference to various molecules, e.g., polynucleotides, polypeptides, enzymes, etc., refers to molecules that are normally or naturally found in and/or produced by a given yeast, bacterium, organism, microorganism, or cell in nature.

The term "heterologous" as used herein in the context of a modified host cell refers to various molecules, e.g., polynucleotides, polypeptides, enzymes, etc., wherein at least one of the following is true: (a) the molecule(s) is/are foreign ("exogenous") to (i.e., not naturally found in) the host cell; (b) the molecule(s) is/are naturally found in (e.g., is "endogenous to") a given host microorganism or host cell but is either produced in an unnatural location or in an unnatural amount in the cell; and/or (c) the molecule(s) differ(s) in nucleotide or amino acid sequence from the endogenous nucleotide or amino acid sequence(s) such that the molecule differing in nucleotide or amino acid sequence from the endogenous nucleotide or amino acid as found endogenously is produced in an unnatural (e.g., greater than naturally found) amount in the cell.

The term "homolog," as used herein with respect to an original enzyme or gene of a first family or species, refers to distinct enzymes or genes of a second family or species which are determined by functional, structural, or genomic analyses to be an enzyme or gene of the second family or species which corresponds to the original enzyme or gene of the first family or species. Homologs most often have functional, structural, or genomic similarities. Techniques are known by which homologs of an enzyme or gene can readily be cloned using genetic probes and PCR. Identity of cloned sequences as homologs can be confirmed using functional assays and/or by genomic mapping of the genes.

A protein has "homology" or is "homologous" to a second protein if the amino acid sequence encoded by a gene has a similar amino acid sequence to that of the second gene. Alternatively, a protein has homology to a second protein if the two proteins have "similar" amino acid sequences. Thus, the term "homologous proteins" is intended to mean that the two proteins have similar amino acid sequences. In certain instances, the homology between two proteins is indicative of its shared ancestry, related by evolution. The terms "homologous sequences" or "homologs" are thought, believed, or known to be functionally related. A functional relationship may be indicated in any one of a number of ways, including, but not limited to: (a) degree of sequence identity and/or (b) the same or similar biological function. Preferably, both (a) and (b) are indicated. The degree of sequence identity may vary, but in one embodiment, is at least 50% (when using standard sequence alignment programs known in the art), at least 60%, at least 65%, at least 70%, at least 75%, at least 80%, at least 85%, at least 90%, at least about 91%, at least about 92%, at least about 93%, at least about 94%, at least about 95%, at least about 96%, at least about 97%, at least about 98%, or at least 98.5%, or at least about 99%, or at least 99.5%, or at least 99.8%, or at least 99.9%. Homology can be determined using software programs readily available in the art, such as those discussed in *Current Protocols in Molecular Biology* (F. M. Ausubel et al., eds., 1987) Supplement 30, section 7.718, Table 7.71. Some alignment programs are MacVector (Oxford Molecular Ltd, Oxford, U.K.) and ALIGN Plus (Scientific and Educational Software, Pennsylvania). Other non-limiting alignment programs include Sequencher (Gene Codes, Ann Arbor, Mich.), AlignX, and Vector NTI (Invitrogen, Carlsbad, Calif.). A similar biological function may include, but is not limited to: catalyzing the same or similar enzymatic reaction; having the same or similar selectivity for a substrate or co-factor; having the same or similar stability; having the same or similar tolerance to various fermentation conditions (temperature, pH, etc.); and/or having the same or similar tolerance to various metabolic substrates, products, by-products, intermediates, etc. The degree of similarity in biological function may vary, but in one embodiment, is at least 1%, at least 2%, at least 3%, at least 4%, at least 5%, at least 6%, at least 7%, at least 8%, at least 9%, at least 10%, at least 20%, at least 30%, at least 40%, at least 50%, at least 60%, at least 65%, at least 70%, at least 75%, at least 80%, at least 85%, at least 90%, at least about 91%, at least about 92%, at least about 93%, at least about 94%, at least about 95%, at least about 96%, at least about 97%, at least about 98%, or at least 98.5%, or at least about 99%, or at least 99.5%, or at least 99.8%, or at least 99.9%, according to one or more assays known to one skilled in the art to determine a given biological function.

The term "variant" refers to any polypeptide or enzyme described herein. A variant also encompasses one or more components of a multimer, multimers comprising an individual component, multimers comprising multiples of an individual component (e.g., multimers of a reference molecule), a chemical breakdown product, and a biological breakdown product. In particular, non-limiting embodiments, an enzyme may be a "variant" relative to a reference enzyme by virtue of alteration(s) in any part of the polypeptide sequence encoding the reference enzyme. A variant of a reference enzyme can have enzyme activity of at least 10%, at least 30%, at least 50%, at least 80%, at least 90%, at least 100%, at least 105%, at least 110%, at least 120%, at least 130% or more in a standard assay used to measure enzyme activity of a preparation of the reference enzyme. In some embodiments, a variant may also refer to polypeptides having at least 50%, at least 60%, at least 70%, at least 80%, at least 90%, at least 91%, at least 92%, at least 93%, at least 94%, at least 95%, at least 96%, at least 97%, at least 98%, or at least 99% sequence identity to the full-length, or unprocessed enzymes of the present disclosure. In some embodiments, a variant may also refer to polypeptides having at least 50%, at least 60%, at least 70%, at least 80%, at least 90%, at least 91%, at least 92%, at least 93%, at least 94%, at least 95%, at least 96%, at least 97%, at least 98%, or at least 99% sequence identity to the mature, or processed enzymes of the present disclosure.

The term "signal sequence" as used herein refers to an amino acid sequence that targets peptides and polypeptides to cellular locations or to the extracellular environment. Signal sequences are typically at the N-terminal portion of a polypeptide and are typically removed enzymatically. Polypeptides that have their signal sequences are referred to as being full-length and/or unprocessed. Polypeptides that have had their signal sequences removed are referred to as being mature and/or processed.

The term "yield potential" as used herein refers to a yield of a product from a biosynthetic pathway. In one embodiment, the yield potential may be expressed as a percent by weight of end product per weight of starting compound.

The term "thermodynamic maximum yield" as used herein refers to the maximum yield of a product obtained from fermentation of a given feedstock, such as glucose, based on the energetic value of the product compared to the feedstock. In a normal fermentation, without use of additional energy sources such as light, hydrogen gas or methane or electricity, for instance, the product cannot contain more energy than the feedstock. The thermodynamic maximum yield signifies a product yield at which all energy and mass from the feedstock is converted to the product. This yield can be calculated and is independent of a specific pathway. If a specific pathway towards a product has a lower yield than the thermodynamic maximum yield, then it loses mass and can most likely be improved upon or substituted with a more efficient pathway towards the product.

The term "redox balanced" refers to a set of reactions, which taken together produce as much redox cofactors as they consume. Designing metabolic pathways and engineering an organism such that the redox cofactors are balanced or close to being balanced usually results in a more efficient, higher yield production of the desired compounds. Redox reactions always occur together as two half-reactions happening simultaneously, one being an oxidation reaction and the other a reduction reaction. In redox processes, the reductant transfers electrons to the oxidant. Thus, in the reaction, the reductant or reducing agent loses electrons and is oxidized, and the oxidant or oxidizing agent gains electrons and is reduced. In one embodiment, the redox reactions take place in a biological system. Biological energy is frequently stored and released by means of redox reactions. Photosynthesis involves the reduction of carbon dioxide into sugars and the oxidation of water into molecular oxygen. The reverse reaction, respiration, oxidizes sugars to produce carbon dioxide and water. As intermediate steps, the reduced carbon compounds are used to reduce nicotinamide adenine dinucleotide (NAD+), which then contributes to the creation of a proton gradient, which drives the synthesis of adenosine triphosphate (ATP) and is maintained by the reduction of oxygen. The term redox state is often used to describe the balance of GSH/GSSG, NAD+/NADH and NADP+/NA- DPH in a biological system such as a cell or organ. The redox state is reflected in the balance of several sets of metabolites (e.g., lactate and pyruvate, beta-hydroxybutyrate, and acetoacetate), whose interconversion is dependent on these ratios. An abnormal redox state can develop in a variety of deleterious situations, such as hypoxia, shock, and sepsis.

The terms "C2 pathway", "C2 branch pathway", "C2 biochemical pathway" or "C2 stream" as used herein refers to a biochemical pathway wherein MEG can be produced via glycolaldehyde.

The terms "C3 pathway", "C3 branch pathway", "C3 biochemical pathway" or "C3 stream" as used herein refers to a biochemical pathway wherein MEG and/or one or more co-product such as acetone, isopropanol, propene, isobutene and/or serine pathway compounds can be produced via pyruvate, acetyl-CoA or dihydroxyacetonephosphate (DHAP).

The terms "C5 sugars" and "pentose sugars" are used interchangeably and refer to sugar molecules comprised of 5 carbon atoms. Similarly, the terms "C6 sugars" and "hexose sugars" are used interchangeably and refer to sugar molecules comprised of 6 carbon atoms. The sugars can be monomers, oligomers, or a combination thereof. In a further exemplary embodiment, the sugar is glucose or oligomers of glucose thereof. In other embodiments, the oligomers of glucose are selected from fructose, sucrose, starch, cellobiose, maltose, lactose and cellulose. In yet further embodiments, the sugars comprise D-xylose, D-galactose, D-mannose, D-arabinose, L-arabinose, D-fructose, or a combination thereof.

Introduction

This disclosure allows accessing the broadly usable key intermediates glyceraldehyde-3-phosphate (G3P) and glycolaldehyde, without carbon loss, from a variety of C5 (pentose) and C6 (hexose) sugars, relying mainly on natural, proven reactions, by introducing just one new reaction catalyzed by a pentose-phosphate aldolase. In some embodiments, hexoses may be selected from D-allose, D-altrose, D-glucose, D-mannose, D-gulose, D-idose, D-galactose, D-talose, D-tagtose, D-sorbose, D-fructose, D-psicose, and other hexoses known in the art. In some embodiments, pentoses may be selected from D-xylose, D-ribose, D-arabinose, D-lyxose, D-xylulose, D-ribulose, and other pentoses known in the art. In some embodiments, the hexoses and pentoses may be selected from the levorotary or dextrorotary entatiomer of any of the hexoses and pentoses disclosed herein.

The described enzyme reactions of the disclosure allow, for instance, for high yield MEG (or glycolic acid), or MEG (or GA) and co-products production from glucose, xylose or various other sugars than can enter into the pentose phosphate pathway or a variety of sugar oligomers which can be readily broken down to the aforementioned monomers, or a mixture of those.

Compared to other glucose based MEG (or glycolic acid) production methods, the present methods solve or reduce the following problems: ATP shortage; large NADH excess; low overall product yield potential. Compared to other glucose based MEG or glycolic acid production methods, the present methods further allow utilization of D-glucose, D-xylose, and/or various other sugars or mixtures with the same high yield.

Compared to other D-xylose based MEG (or glycolic acid) production methods, as well as other D-xylose based MEG and co-product production methods, the present methods solve the following challenges and problems: a process depending on xylose (availability/market limitations, high price or low purity, slower and less efficient uptake than D-glucose); glucose induced inhibition of D-xylose utilization. Compared to other D-xylose based MEG (or glycolic acid) production methods, as well as other D-xylose based MEG and co-product production methods, the present methods further allow utilization of D-glucose, D-xylose, and/or various other sugars or mixtures with the same high yield.

All currently known MEG (or glycolic acid) production methods using glucose as feedstock have low yield potential. This is an intrinsic drawback of the biochemistry of how glucose is degraded to MEG, with one decarboxylation occurring per produced MEG (or glycolic acid) molecule for all the proposed and known pathways. However, one decarboxylation per MEG is too much to achieve redox-neutral and therefore optimal yield.

This disclosure describes an entirely new way of pentose or hexose degradation via the pentose phosphate pathway and/or its key pentose-phosphate interediates, including D-ribose-5-phosphate, D-ribulose-5-phosphate and D-xylulose-5-phosphate, by establishing a so far undescribed pentose-phosphate aldolase reaction, wherein the aldolase hase D-ribose-5-phosphate aldolase activity, D-ribulose-5-phosphate aldolase activity or D-xylulose-5-phosphate aldolase activity, producing the key precursors glycoladehyde and glyceraldehyde 3-phosphate (G3P) (FIG. 1). Depending on the entry into the pentose phosphate pathway, this conversion is achieved without losing carbon, even from hexoses. This disclosure thus allows for the hexose and/or pentose based production of various G3P or glycolaldehyde derivatives with high yield.

Utilization of a Non-Oxidative Entry into Pentose Phosphate Pathway

This technology can be used with a lossless transformation of glucose to a pentose-phosphate intermediate via the non-oxidative pentose phosphate pathway. Wherein the pentose-phosphate intermediate comprise D-ribose-5-phosphate, D-ribulose-5-phosphate or D-xylulose-5-phosphate. A transketolase, such as encoded by tktA or tktB from *E. coli*, is used as a non-oxidative entry into the pentose phosphate pathway to transform the glycolysis intermediates D-fructose 6-phosphate and D-glyceraldehyde 3-phosphate into D-xylulose 5-phosphate and D-erythrose 4-phosphate. D-erythrose 4-phosphate and another D-fructose 6-phosphate are further processed by a transaldolase (such as talA or talB from *E. coli*) and then by a transketolase to D-ribose 5-phosphate and D-xylulose 5-phosphate. The D-xylulose 5-phosphate molecules can be readily transformed into D-ribose 5-phosphate by D-ribulose 5-phosphate 3-epimerase (rpe) and D-ribose 5-phosphate isomerase (rpi) (FIG. 1).

The final equation is:

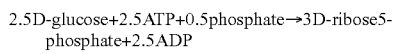
2.5D-glucose+2.5ATP+0.5phosphate→3D-ribose5-phosphate+2.5ADP

If D-xylose is used as carbon source, a simple isomerization (xylA in *E. coli*) and activation (xylB in *E. coli*, xylulose 5-kinase) generates D-xylulose 5-phosphate, which through rpe and rpi action can be transformed into D-ribose 5-phosphate. This is already the natural route of xylose utilization in many organisms such as *E. coli*.

The final equation is:

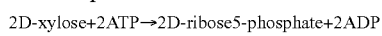
2D-xylose+2ATP→2D-ribose5-phosphate+2ADP

Optimization of Flux Towards Non-Oxidative Entry into Pentose Phosphate Pathway

To avoid the loss of one carbon, the oxidative entry into the pentose phosphate pathway via 6-phospho D-glucono- 1,5-lactone and oxidative decarboxylation to D-ribulose 5-phosphate, the common pathway in *E. coli*, should not be utilized. It is advantageous to inhibit at least one or more of the appropriate reactions, namely glucose 6-phosphate 1-dehydrogenase, 6-phosphogluconolactonase, and 6-phosphogluconate dehydrogenase, by deleting or repressing one or more of the genes responsible (in *E. coli* zwf, pgl, gnd).

Utilization of Alternative, Non-Oxidative Entry into Pentose Phosphate Pathway

Figure 2:
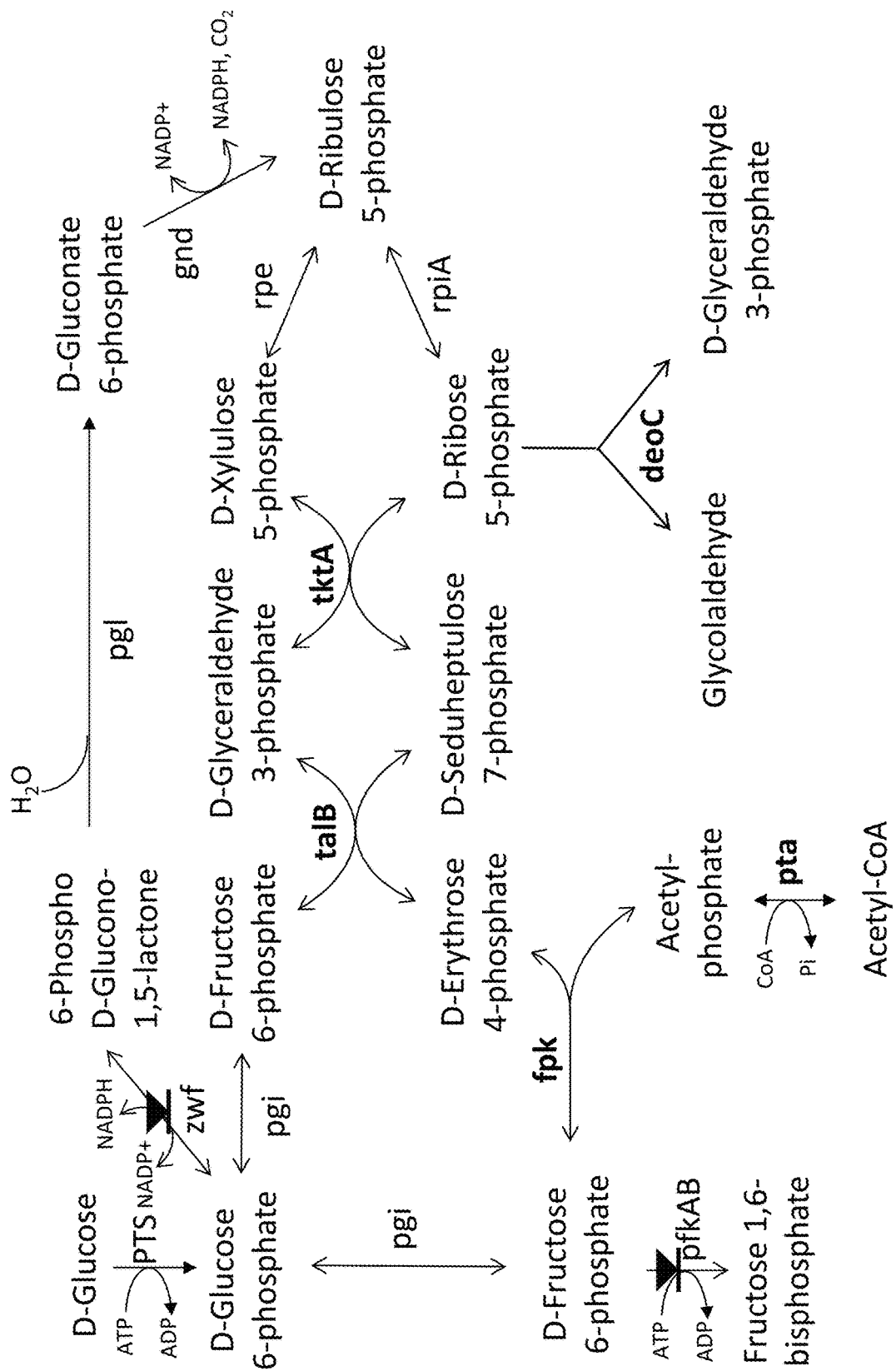
FIG. 2 illustrates a variation of a degradation pathway for pentoses or hexoses that comprise fructose-6-phosphate phosphoketolase (Fpk) and phosphate acetyltransferase (pta). The symbol  means enzymes to be potentially down regulated or inactivated/abolished, ie. respective gene potentially attenuated or deleted.

Alternatively, a specific D-fructose 6-phosphate phosphoketolase (Fpk) and a phosphate acetyltransferase (PTA) can be used as lossless entry into the pentose phosphate pathway, making one D-erythrose 4-phosphate and one acetyl-CoA from D-fructose 6-phosphate. D-Erythrose 4-phosphate and a further D-fructose 6-phosphate are processed to two D-ribose 5-phosphates, as described above (FIG. 2).

The final equation is:

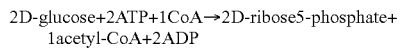

2D-glucose+2ATP+1CoA→2D-ribose5-phosphate+ 1acetyl-CoA+2ADP

Downregulation of Glycolysis Downstream Reactions

The upper part of glycolysis is needed to transform 2.5 D-glucose or D-fructose into the key intermediates 2× D-fructose 6-phosphate and 1× D-glyceraldehyde 3-phosphate. To reduce or eliminate further flux through the lower part of glycolysis, i.e. the oxidative phosphorylation of D-glyceraldehyde 3-phosphate to 1,3-bisphospho D-glycerate and its subsequent conversion to 3-phospho-D-glycerate and 2-phospho-D-glycerate, activity of D-glyceraldehyde 3-phosphate dehydrogenase, phosphoglycerate kinase and phosphoglycerate mutase, encoded by gapA, pgk and gpmA/gpmM, respectively, in *E. coli*, can be diminished.

If the alternative entry into the pentose phosphate pathway via Fpk is utilized, then no D-glyceraldehyde 3-phosphate is needed and the appropriate 6-phosphofructokinase activity can be diminished or deleted (genes pfkA and/or pfkB in *E. coli*).

Utilization of Further Sugars

Figure 3:
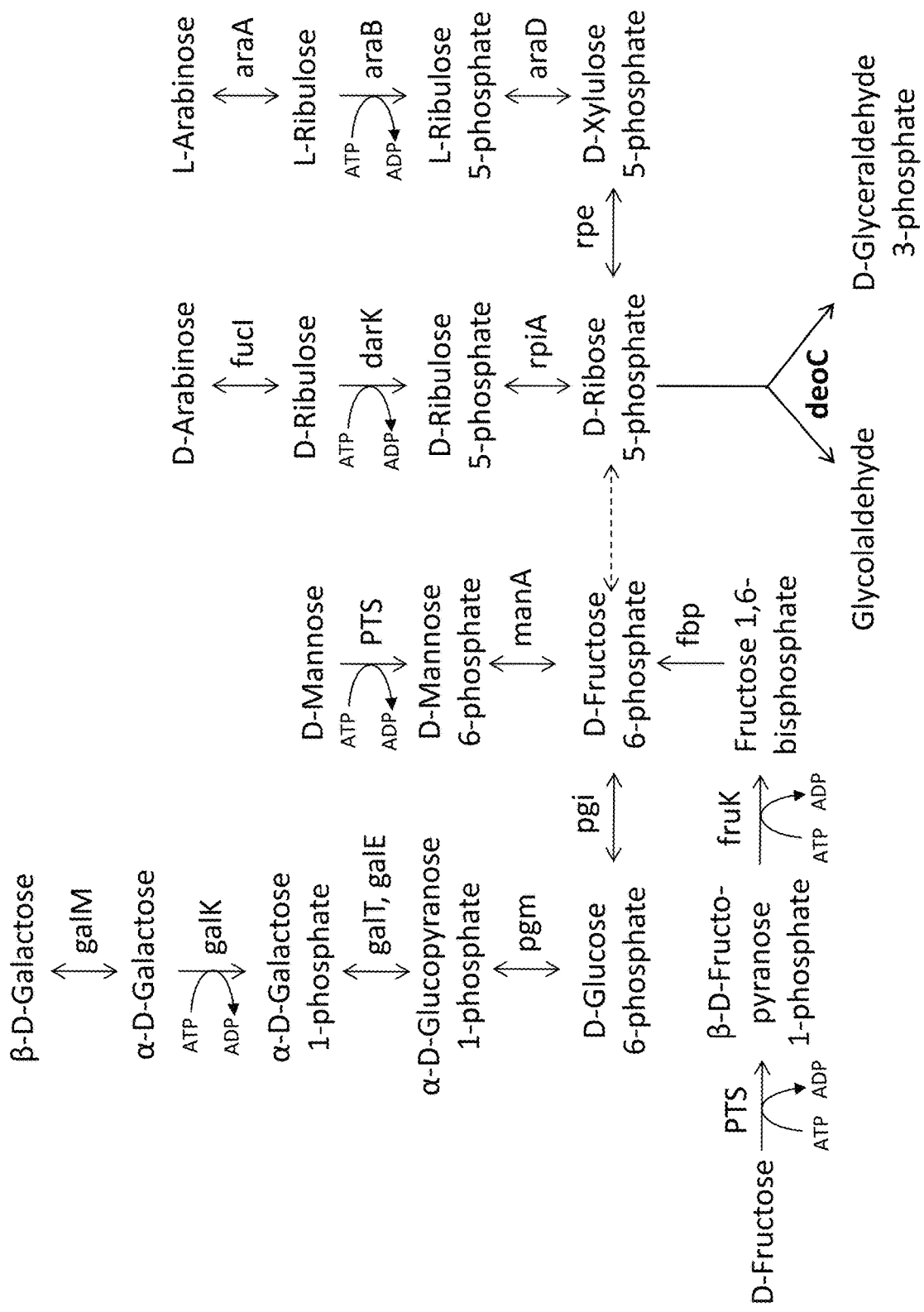
FIG. 3 illustrates lossless transformation of various sugars to glycolaldehyde and glyceraldehyde 3-phosphate.

If an organism has or was endowed with the ability to consume starch or sucrose or cellulose or maltose, or oligomers of C5 or C6 sugars like glucose or xylose, for instance via expression of a sucrose invertase or cellobiose importer and cellobiose hydrolase, or any other sugar that can be degraded via the pentose phosphate pathway, it can generate the key intermediate of this disclosure, D-ribose 5-phosphate, thus enabling it to utilize the compositions and methods of the present disclosure in the same way and to the same extent, yielding the same benefits. For instance, L- or D-arabinose can both be naturally processed in *E. coli*, without carbon loss, via known degradation pathways, into the pentose phosphate pathway intermediates D-xylulose 5-phosphate or D-ribulose 5-phosphate, respectively (FIG. 3). These can then be readily converted into D-ribose 5-phosphate via rpe and rpi mediated activity. Also D-mannose or D-galactose are naturally, for instance in *E. coli*, degraded into the pentose phosphate pathway entry molecule D-fructose 6-phosphate.

D-fructose, in *E. coli*, is not degraded via D-fructose 6-phosphate, but rather via D-fructose 1-phosphate and D-fructose 1,6-bisphosphate. However, a simple overexpression of the intrinsic fructose 1,6-bisphosphatase would lead to D-fructose 6-phosphate and therefore enable utilization of this invention with D-fructose, or D-fructose yielding oligomers like sucrose.

Possible Utilization of the Reaction Products

G3P is an early key intermediate of glycolysis, and thus can be used for the synthesis of the majority of chemicals which can be derived from glucose, such as, but not limited to, acetone, 2-propanol, propene, isobutene, monoethylene glycol (MEG), glycolic acid (GA) and serine pathway compounds. Serine pathway compounds can include L-serine, glycine, monoethanolamine (MEA) and ethylenediamine (EDA). Glycolaldehyde can be readily converted to MEG via reduction or GA via oxidation (FIG. 4 and FIG. 5).

Most organisms can also naturally oxidize glycolaldehyde to glyoxylic acid and further convert it into the common intermediates oxaloacetate, malate, or 2-phosphoglycerate (via tartronate semialdehyde). These intermediates can be turned into biomass or a variety of chemical compounds. If these reactions should be avoided, for instance to improve MEG production, they can be diminished or eliminated by reducing or deleting activity of the appropriate genes.

High Yield Production of MEG

Figure 4:
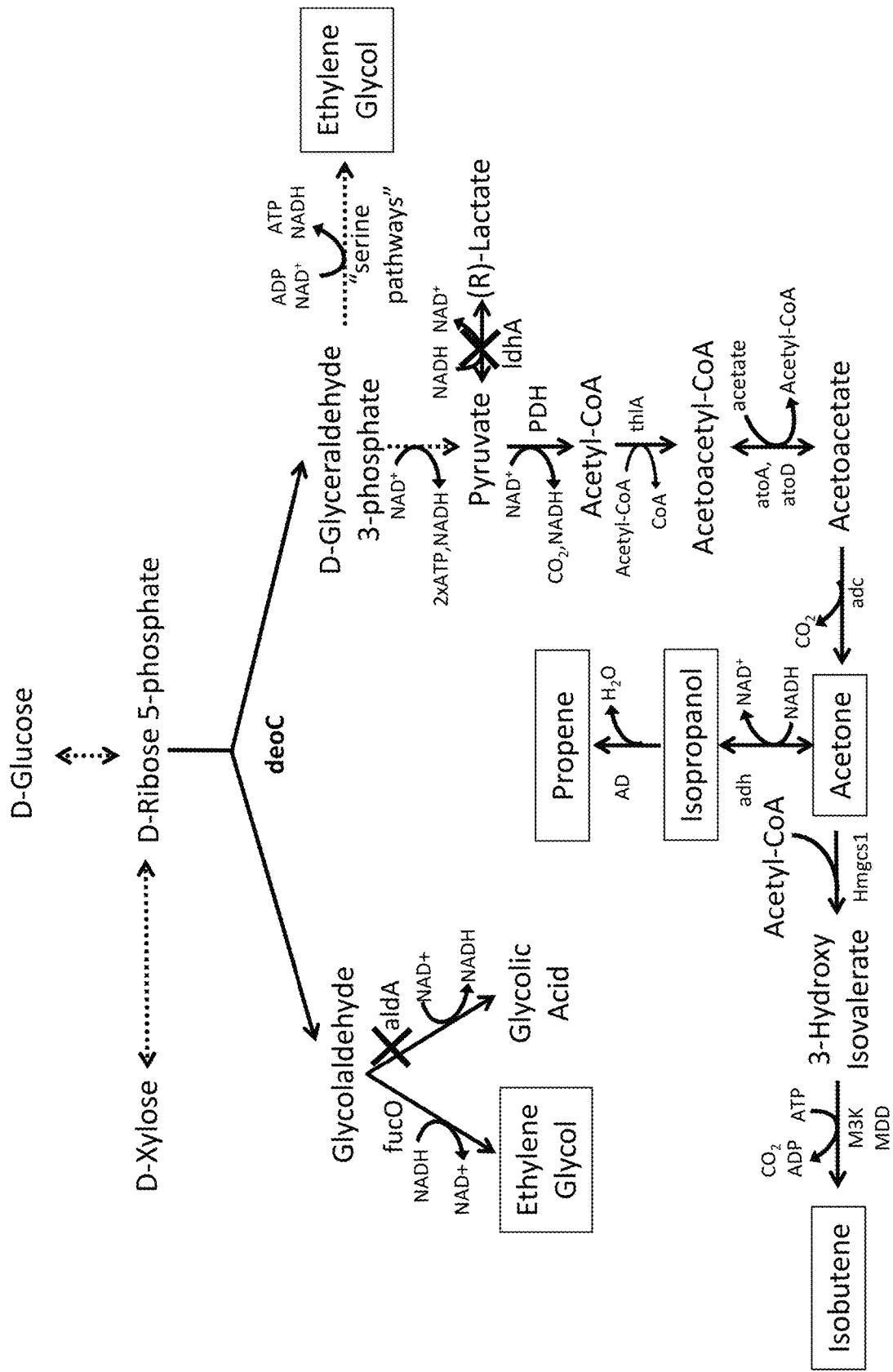
FIG. 4 illustrates high yield MEG and possible co-production pathways via pentose-phosphate (D-ribose 5-phosphate, D-ribulose 5-phosphate and D-xylulose 5-phosphate).
Figure 5:
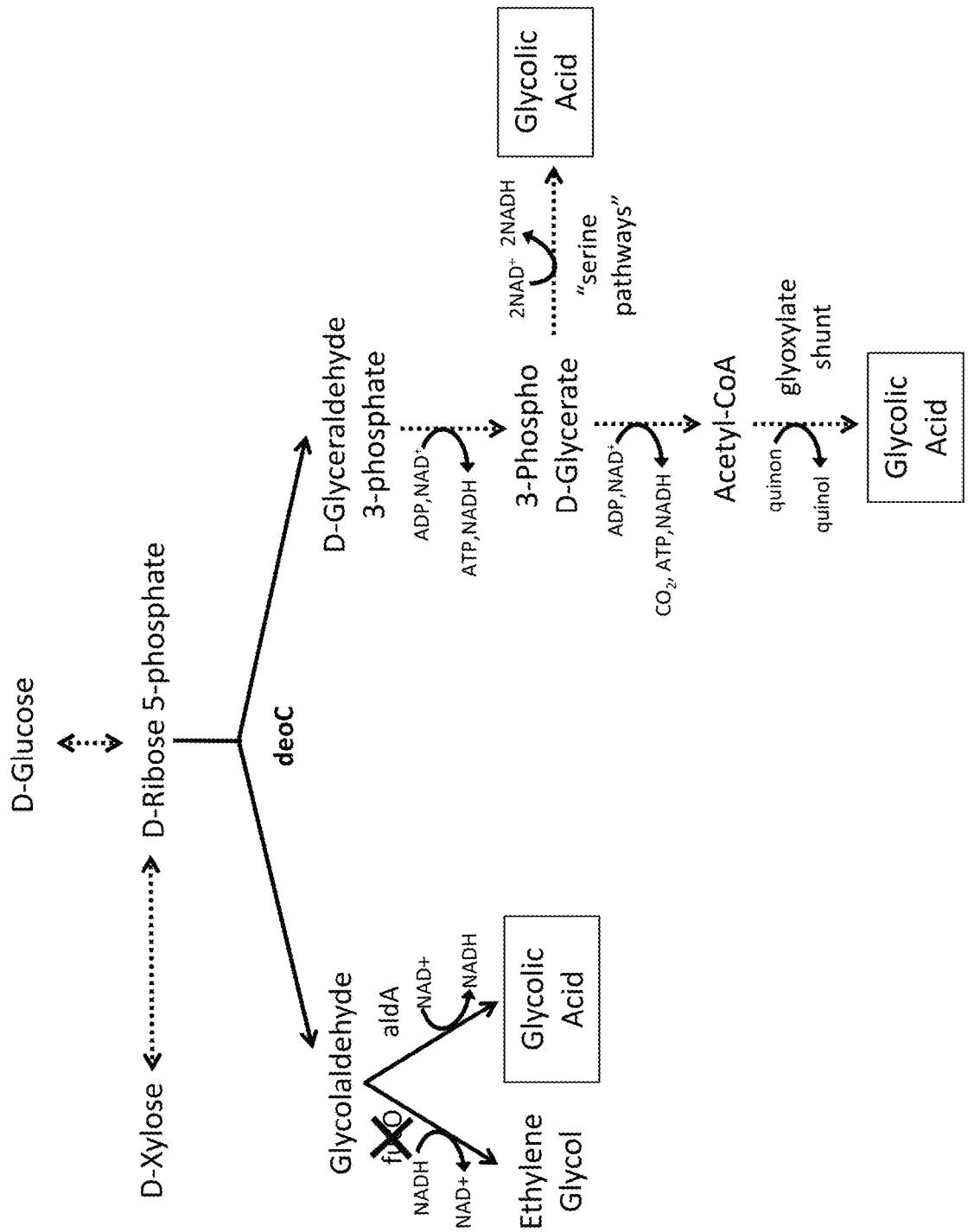
FIG. 5 illustrates high yield glycolic acid pathways via pentose-phosphate (D-ribose 5-phosphate, D-ribulose 5-phosphate and D-xylulose 5-phosphate).

This technology allows a new, advantageous, high yield pathway for the production of MEG from glucose or xylose, or even mixtures of both sugars utilizing the same core degradation pathway (FIG. 4).

If glucose is utilized for MEG production, then all methods described so far teach a degradation via glycolysis to 3-phosphoglycerate and further via L-serine pathway reactions to MEG. However, this way this 3-carbon compound will be degraded to one 2-carbon compound (MEG), losing one $CO_2$ per MEG, which is true for all described pathway variations. The $CO_2$ production in excess is accompanied by an overproduction of reducing equivalents (NADH) and leads to a significant loss of yield potential (only 0.69 g_MEG per gram of sugar, vs 0.82 g_MEG thermodynamic maximum yield potential):

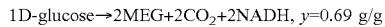

1D-glucose→2MEG+2$CO_2$+2NADH, y=0.69 g/g

Fermentative MEG production is described in WO2010/076324 (or US2011/0294178, Metabolic Explorer), which is herein incorporated in its entirety. This application suggested diol production via 2-ketoacid decarboxylation and reduction, including a serine biosynthesis based pathway to the intermediate hydroxypyruvate and further to ethyleneglycol. However, the disclosed pathway has a reduced total yield potential of 0.69 g_MEG/g_glucose, while the thermodynamic maximum yield for a glucose→MEG conversion is 0.82 g/g. This pathway is also not redox balanced and has a high excess of 2 mol NADH per mol of consumed glucose, all of which needs to be re-oxidized for the cell to be viable. In an aerobic fermentation, this NADH can be used to generate ATP, which however would be in high excess (2 NADH→6 ATP), leading to excess biomass formation during the production phase and therefore reduced product formation and yield.

Thus, the fermentative MEG production pathway disclosed in WO2010/076324 has an ATP shortage (−1 ATP per MEG), excess NADH (+1 NADH per MEG), low yield potential (ymax=0.69 g_MEG/g_glucose) and is a challenging pathway that has not been demonstrated at high efficiency/productivity.

The disclosure of WO2011/130378A1 (or US2011/0312049, Genomatica) proposes an approach similar to WO2010/076324 to produce MEG from glucose via hydroxypyruvate, but also mentions pathway variations with alternative, but related key intermediates glycerate or ethanolamine.

The disclosure of WO2011/130378A1 has the same drawbacks as WO2010/076324, except for ATP shortage. ATP can be +0 or +1 per MEG, depending on utilized enzymes.

The present disclosure allows a redox-neutral MEG yield from D-glucose of 0.827 g/g if the non-oxidative pentose phosphate pathway is used to transform D-glucose to D-ribose 5-phosphate (FIG. 4).

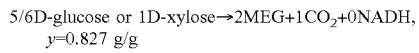
y=0.827 g/g

Turning to the use of D-xylose, other recent disclosures have demonstrated D-xylose to MEG pathways with a yield of 0.827 g/g.

A demonstrated fermentative production of MEG from xylose (WO2013/126721), via ribulose-1-phosphate, has a high yield potential (0.82 g_MEG/g_xylose) which equals the thermodynamic maximum yield. It produces MEG via two different pathways which are active in parallel, a 2-carbon stream (via glycolaldehyde) and a 3-carbon stream (via dihydroxyacetonephosphate). The C2 stream is easy to implement, but the C3 stream is difficult to implement at high efficiency via metabolic engineering. The C3 stream utilizes the pathways presented in WO2010/076324 or WO2011/130378.

Assuming a typically ATP driven xylose import, the overall process is at least ATP neutral. Thus, some xylose and therefore yield will be lost in order to obtain some surplus ATP required for cell growth and maintenance.

However, the uptake of xylose is not as efficient and fast as that of glucose, the preferred carbon source of most microorganisms. Also, presence of glucose in the media usually inhibits utilization of other sugars such as xylose. For a more efficient process, the organism's regulation leading to this preferential consumption needs to be disrupted and the strain adapted towards xylose preference or sugar co-consumption.

The key challenge, however, is obtaining xylose as an affordable and clean feedstock. Xylose as pure chemical is expensive and not available in bulk quantities. Xylose in hemicellulose hydrolysates is available in larger quantities and at potentially lower cost than glucose, but is accompanied by many impurities and substances that inhibit fermentations.

Therefore, the fermentative production of MEG (or glycolic acid) from xylose (WO2013/126721) poses a challenge with respect to using xylose as feedstock (availability, price, purity, inhibition of xylose utilization by glucose) and to using a C3 pathway, which has not been demonstrated at high efficiency/productivity. Moreover, there is an ATP shortage, +0 ATP (or −1 ATP if not using glycerate kinase), which is not sufficient for cell maintenance.

A further demonstrated fermentative production of MEG from xylose (Alkim et al., Microb Cell Fact (2015) 14:127), via xylulose-1-phosphate, is very similar to the route described by WO2013/126721. It has the same high yield potential (0.82 g/g), difficult to implement C3 stream for MEG production via DHAP, ATP shortage and feedstock challenges.

Another demonstrated fermentative production of MEG from xylose (WO2013/119020), via xylonate, shares similarities to the route described by WO2013/126721. It produces glycolaldehyde and pyruvate as key intermediates, allowing MEG production from glycolaldehyde with a yield potential of 0.41 g/g. This represents a high relative yield since it is achieved with only half the flux. However, no pathway to convert the remaining pyruvate to MEG is presented in WO2013/119020 or elsewhere. Currently, no realistic and efficient pathway is known to convert pyruvate to MEG. While pyruvate as a co-product itself would enable a redox neutral overall process (+0 NADH), it is not an economically interesting product and the process would lack 1 ATP (probably −2 ATP more for pyruvate export). Thus, ideally a pyruvate derived, economically interesting co-product at high yield is required that delivers surplus ATP. Therefore, the fermentative production of MEG from xylose (WO2013/119020), via xylonate, poses a challenge with respect to using xylose as feedstock (availability, price, purity, inhibition of xylose utilization by glucose), low absolute yield of MEG, ATP shortage (depending on co-product, it could be −1 to −3 ATP with pyruvate), and to requiring a pyruvate derived co-product with high yield potential and surplus ATP.

The present disclosure presents a further solution for high yield MEG production from D-xylose. However, unlike the previous solutions, this solution also allows a high yield MEG production from D-glucose, using the same core degradation pathway.

High Yield Co-Production of MEG and DHAP Derived Compounds

The present disclosure also allows for an advantageous, high yield pathway for the co-production of MEG, which requires reducing equivalents, with a compound whose biosynthetic pathway generates reducing equivalents, such as acetone, 2-propanol, propene, isobutene, and/or serine pathway compounds. In some embodiments, the serine pathway compounds include L-serine, glycine, monoethanolamine (MEA) and/or ethylenediamine (EDA). While the synergistic co-production of MEG with other compounds has been described previously (see U.S. Application No. 62/305,814, U.S. Application No. 62/430,742 and U.S. Application No. 62/406,684, each of which is herein incorporated in its entirety), this solution allow utilization not just of D-xylose, but D-glucose and even mixtures of D-glucose and D-xylose with the same high yield and synergistic co-production advantages.

High Yield Production of Glycolic Acid (GA)

The described pathways from D-glucose to GA also go through 3-phosphoglycerate and L-serine pathway reactions, or via the glyoxylate shunt. In both cases, one $CO_2$ is lost per glycolic acid, again in excess, leading to a maximum yield of only 0.84 g/g, much lower than the thermodynamic maximum yield potential (1.7 g/g):

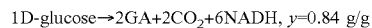

New pathways with improved yield for the production of GA have been described (WO2016079440, WO2013126721, WO2013119020). However, they work only if D-xylose is used as carbon source, which is currently not readily available as a commodity:

Using the compositions and methods of the present disclosure, the yield from D-glucose (with non-oxidative pentose phosphate pathway) is significantly increased. It also works with D-xylose with the same yield (FIG. 5):

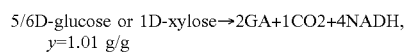
y=1.01 g/g

The following stoichiometries are given for production of MEG (or glycolic acid, GA) via standard pathways using D-glucose or D-xylose versus the pathways of the present disclosure using D-glucose or D-xylose.

Stoichiometries associated with standard D-glucose pathways (such as disclosed in WO2010/076324 or WO2011/130378A1) for MEG or GA production:

1D-glucose→2GA+6NADH+0ATP; y=0.844 g/g

Or 1D-glucose→2MEG+4NADH+0ATP; y=0.689 g/g

Stoichiometries associated with pathways of the present disclosure using D-glucose for MEG or GA production:

2.5D-glucose+2.5ATP+0.5phosphate→3R5P→3GA+ 3DHAP+3NADH→6GA+12NADH+3ATP 1D-glucose→2.4GA+4.8NADH+1.2ATP; y=1.01 g/g Or 1D-glucose→2.4MEG+0NADH+1.2ATP, y=0.827 g/g Stoichiometries associated with standard D-xylose pathways (such as pathways disclosed in WO2013/126721 or in Alkim et al., Microb Cell Fact (2015) 14:127) for MEG or GA production:

1D-xylose→2GA+4NADH-1ATP*; y=1.01 g/g

Or 1D-xylose→2MEG+0NADH-1ATP*; y=0.827 g/g

*~-0.1 ATP if XylE symporter is used instead of XylFGH active xylose importer

Stoichiometries associated with pathways of the present disclosure using D-xylose for MEG or GA production:

1D-xylose+2ATP→D-xylulose5-P→D-Ribose5- P→GA+1NADH+DHAP→2GA+4NADH+ 1ATP 1D-xylose→2GA+4NADH-1ATP*; y=1.01 g/g Or 1D-xylose→2MEG+0NADH-1ATP*; y=0.827 g/g

*~-0.1 ATP if XylE symporter is used instead of XylFGH active xylose importer

Monoethylene Glycol (MEG)

Monoethylene glycol (MEG) is an important raw material for industrial applications. A primary use of MEG is in the manufacture of polyethylene terephthalate (PET) resins, films and fibers. In addition, MEG is important in the production of antifreezes, coolants, aircraft anti-icer and deicers and solvents. MEG is also known as ethane-1,2-diol.

Ethylene glycol is also used as a medium for convective heat transfer in, for example, automobiles and liquid cooled computers.

Because of its high boiling point and affinity for water, ethylene glycol is a useful desiccant. Ethylene glycol is widely used to inhibit the formation of natural gas clathrates (hydrates) in long multiphase pipelines that convey natural gas from remote gas fields to a gas processing facility. Ethylene glycol can be recovered from the natural gas and reused as an inhibitor after purification treatment that removes water and inorganic salts.

Minor uses of ethylene glycol include in the manufacture of capacitors, as a chemical intermediate in the manufacture of 1,4-dioxane, and as an additive to prevent corrosion in liquid cooling systems for personal computers. Ethylene glycol is also used in the manufacture of some vaccines; as a minor ingredient in shoe polish, inks and dyes; as a rot and fungal treatment for wood; and as a preservative for biological specimens.

Glycolic Acid

Glycolic acid is used in the textile industry as a dyeing and tanning agent, in food processing as a flavoring agent and as a preservative, and in the pharmaceutical industry as a skin care agent. It is also used in adhesives and plastics. Glycolic acid is often included into emulsion polymers, solvents and additives for ink and paint in order to improve flow properties and impart gloss. It is used in surface treatment products that increase the coefficient of friction on tile flooring.

Due to its excellent capability to penetrate skin, glycolic acid finds applications in skin care products to improve the skin's appearance and texture. It can be used as a chemical peel performed by a dermatologist in concentrations of 20 to 70% or at-home kits in lower concentrations between 10 and 20%. In addition to concentration, pH also plays a large part in determining the potency of glycolic acid in solution.

Glycolic acid can be synthesized in various ways. The predominant approach uses a catalyzed reaction of formaldehyde with synthesis gas (carbonylation of formaldehyde), for its low cost. It is also prepared by the reaction of chloroacetic acid with sodium hydroxide followed by re-acidification. Other methods, not noticeably in use, include hydrogenation of oxalic acid, and hydrolysis of the cyanohydrin derived from formaldehyde. Some of today's glycolic acids are formic acid-free. Glycolic acid can be isolated from natural sources, such as sugarcane, sugar beets, pineapple, cantaloupe and unripe grapes.

Glycolic acid is a useful intermediate for organic synthesis, in a range of reactions including: oxidation-reduction, esterification and long chain polymerization. It is used as a monomer in the preparation of polyglycolic acid and other biocompatible copolymers (e.g. PLGA). Commercially, important derivatives include the methyl (CAS #96-35-5) and ethyl (CAS #623-50-7) esters which are readily distillable. The butyl ester is a component of some varnishes, being desirable because it is nonvolatile and has good dissolving properties.

Acetone

Acetone (also known as propanone) is an organic compound with the formula $(CH3)_2CO$. It is a colorless, volatile, flammable liquid, and is the simplest ketone.

Acetone is miscible with water and serves as an important solvent, typically for cleaning purposes in the laboratory. Over 6.7 million tonnes are produced worldwide, mainly for use as a solvent and production of methyl methacrylate and bisphenol A. It is a common building block in organic chemistry. Familiar household uses of acetone are as the active ingredient in nail polish remover and as paint thinner.

Isopropanol

Isopropyl alcohol (IUPAC name 2-propanol), also called isopropanol, is a compound with the chemical formula $C_3H_8O$ or $C_3H_7OH$ or $CH_3CHOHCH_3$. It is a colorless, flammable chemical compound with a strong odor. It is the simplest example of a secondary alcohol, where the alcohol carbon atom is attached to two other carbon atoms sometimes shown as $(CH_3)_2CHOH$. It is a structural isomer of propanol. It has a wide variety of industrial and household uses.

Propene, also known as propylene or methyl ethylene, is an unsaturated organic compound having the chemical formula $C_3H_6$. It has one double bond, and is the second simplest member of the alkene class of hydrocarbons.

Propene is produced from fossil fuels—petroleum, natural gas, and, to a much lesser extent, coal. Propene is a byproduct of oil refining and natural gas processing.

Isobutene

Isobutene (also known as isobutylene or 2-methylpropene) is a hydrocarbon of industrial significance. It is a four-carbon branched alkene (olefin), one of the four isomers of butylene (butene). At standard temperature and pressure it is a colorless flammable gas.

Isobutene is used as an intermediate in the production of a variety of products. It is reacted with methanol and ethanol in the manufacture of the gasoline oxygenates methyl tert-butyl ether (MTBE) and ethyl tert-butyl ether (ETBE), respectively. Alkylation with butane produces isooctane, another fuel additive. Isobutene is also used in the production of methacrolein. Polymerization of isobutene produces butyl rubber (polyisobutene). Antioxidants such as butylated hydroxytoluene (BHT) and butylated hydroxyanisole (BHA) are produced by Friedel-Crafts alkylation of phenols using isobutene.

Polymer and chemical grade isobutene is typically obtained by dehydrating tertiary butyl alcohol or catalytic dehydrogenation of isobutane. Gasoline oxygenates MTBE and ETBE are generally produced by reacting methanol or ethanol with isobutene contained in butene streams from olefin steam crackers or refineries. Isobutene is not isolated before the reaction as separating the ethers from the remaining butenes is simpler.

Serine Pathway Compounds

Compounds that may be co-produced with MEG (or glycolic acid) include serine pathway compounds, for example, serine, glycine, monoethanolamine (MEA) and ethylenediamine (EDA).

Serine is a non-essential amino acid that can be synthesized in the human body. Being highly water soluble, serine finds application as moisturizer in lotions of pharma and cosmetic industry. Further, there is a huge market for serine in the chemical industry because it can be converted into other chemicals such as plastics, detergents, dietary supplements and a variety of other products. In fact, serine has been mentioned as one of the 30 most promising biological substances to replace chemicals from the oil industry.

The α-decarboxylation of serine yields ethanolamine, an industrial product used as an intermediate in the herbicide, textile, metal, detergent, plastics, and personal care products industries with a production volume running into several hundreds of kilotonnes per annum (Scott, E. et al. (2007) Biomass in the manufacture of industrial products—the use of proteins and amino acids. Appl Microbiol Biotechnol. 75(4): 751-762).

Glycine, the simplest amino acid, is valuable for pharmaceutical and industrial applications. It is included as an additive in pet food and animal feed. For humans, glycine is sold as a sweetener/taste enhancer. Certain food supplements and protein drinks contain glycine. Certain drug formulations include glycine to improve gastric absorption of the drug. Glycine serves as a buffering agent in antacids, analgesics, antiperspirants, cosmetics, and toiletries. Many miscellaneous products use glycine or its derivatives, such as the production of rubber sponge products, fertilizers and metal complexants. Glycine is also valuable as an intermediate in the synthesis of a variety of chemical products. It is used in the manufacture of the herbicide glyphosate. Glycine can be converted to oxalic acid, which is used as a bleaching agent in the textile and pulp industries and wastewater treatment. Glycine is also extensively used in laboratory research, for example, in gel electrophoresis.

Ethylenediamine (EDA) (1,2-diaminoethane, $C_2H_4(NH_2)_2$) is used in large quantities for production of many industrial chemicals. It forms derivatives with carboxylic acids (including fatty acids), nitriles, alcohols (at elevated temperatures), alkylating agents, carbon disulfide, and aldehydes and ketones. Because of its bifunctional nature, having two amines, it readily forms heterocycles such as imidazolidines. A most prominent derivative of ethylenediamine is the chelating agent EDTA, which is derived from ethylenediamine via a Strecker synthesis involving cyanide and formaldehyde. Hydroxyethylethylenediamine is another commercially significant chelating agent. Numerous bio-active compounds and drugs contain the N—$CH_2$—$CH_2$—N linkage, including some antihistamines. Salts of ethylenebisdithiocarbamate are commercially significant fungicides under the brand names Maneb, Mancozeb, Zineb, and Metiram. Some imidazoline-containing fungicides are derived from ethylenediamine. Ethylenediamine is an ingredient in the common bronchodilator drug aminophylline, where it serves to solubilize the active ingredient theophylline. Ethylenediamine has also been used in dermatologic preparations. When used as a pharmaceutical excipient, after oral administration its bioavailability is about 0.34, due to a substantial first-pass effect. Less than 20% is eliminated by urinal excretion. Ethylenediamine, because it contains two amine groups, is a widely used precursor to various polymers. Condensates derived from formaldehyde are plasticizers. It is widely used in the production of polyurethane fibers. The PAMAM class of dendrimers are derived from ethylenediamine. The bleaching activator tetraacetylethylenediamine is generated from ethylenediamine. The derivative N,N-ethylenebis(stearamide) (EBS) is a commercially significant mold-release agent and a surfactant in gasoline and motor oil.

Ethylenediamine is also used as: a solvent to solubilize proteins such as albumins and casein; certain electroplating baths; corrosion inhibitor in paints and coolants; chemicals for color photography developing, binders, adhesives, fabric softeners, curing agents for epoxys, and dyes. Ethylenediamine dihydroiodide (EDDI) is added to animal feeds as a source of iodide.

Enzymes

Exemplary enzymes that may be used in the MEG or glycolic acid, or MEG and one or more co-product, biosynthesis pathways disclosed herein are listed in Table 1.

TABLE 1

| Described Reaction | EC no. | Required enzyme activity | Gene candidate | Source Organism | Natural/ annotated function |
|---|---|---|---|---|---|
| Isomerases that may be used in conversion of D-xylose to D-xylulose ||||||
| D-xylopyranose <=> D-xylulose | 5.3.1.5 | xylose isomerase | xylA | *Pyromyces* sp. | xylose isomerase |
| D-xylopyranose <=> D-xylulose | 5.3.1.5 | xylose isomerase | xylA | *Escherichia coli* | xylose isomerase |
| Glycolaldehyde reductases that may be used to convert glycolaldehyde to MEG ||||||
| glycolaldehyde + NAD(P)H <=> monoethylene glycol + NAD(P)+ | 1.1.1.— | glycolaldehyde reductase | gldA | *Escherichia coli* | glycerol dehydrogenase |

TABLE 1-continued

| glycolaldehyde + NAD(P)H <=> monoethylene glycol + NAD(P)+ | 1.1.1.— | glycolaldehyde reductase | GRE2 | Saccharomyces cerevisiae | methylglyoxal reductase |
|---|---|---|---|---|---|
| glycolaldehyde + NAD(P)H <=> monoethylene glycol + NAD(P)+ | 1.1.1.— | glycolaldehyde reductase | GRE3 | Saccharomyces cerevisiae | aldose reductase |
| glycolaldehyde + NAD(P)H <=> monoethylene glycol + NAD(P)+ | 1.1.1.— | glycolaldehyde reductase | yqhD* | Escherichia coli | Alcohol dehydrogenase |
| glycolaldehyde + NAD(P)H <=> monoethylene glycol + NAD(P)+ | 1.1.1.— | glycolaldehyde reductase | yqhD | Escherichia coli | Alcohol dehydrogenase |
| glycolaldehyde + NAD(P)H <=> monoethylene glycol + NAD(P)+ | 1.1.1.— | glycolaldehyde reductase | ydjg | Escherichia coli | methylglyoxal reductase |
| glycolaldehyde + NAD(P)H <=> monoethylene glycol + NAD(P)+ | 1.1.1.— | glycolaldehyde reductase | fucO | Escherichia coli | lactaldehyde reductase |
| glycolaldehyde + NAD(P)H <=> monoethylene glycol + NAD(P)+ | 1.1.1.— | glycolaldehyde reductase | yafB (dkgB) | Escherichia coli | methylglyoxal reductase [multifunctional] |
| glycolaldehyde + NAD(P)H <=> monoethylene glycol + NAD(P)+ | 1.1.1.— | glycolaldehyde reductase | yqhE (dkgA) | Escherichia coli | 2,5-diketo-D-gluconic acid reductase A |

Enzymes that may be used in 2-propanol (IPA) pathway via acetone or in acetone pathway to isobutene

| 2 acetyl-Coa -> acetoacetyl-CoA + CoA | 2.3.1.9 | acetyl coenzyme A acetyltransferase | thlA | Clostridium acetobutylicum | acetyl coenzyme A acetyltransferase |
|---|---|---|---|---|---|
| 2 acetyl-Coa -> acetoacetyl-CoA + CoA | 2.3.1.9 | acetyl coenzyme A acetyltransferase | atoB | Escherichia coli | acetyl coenzyme A acetyltransferase |
| 2 acetyl-Coa -> acetoacetyl-CoA + CoA | 2.3.1.9 | acetyl coenzyme A acetyltransferase | ERG10 | Saccharomyces cerevisiae | acetyl coenzyme A acetyltransferase |
| acetoacetyl-CoA + acetate -> acetoacetate + acetyl-CoA | 2.8.3.8 | Acetyl-CoA: acetoacetate-CoA transferase subunit | atoA | Escherichia coli | Acetyl-CoA: acetoacetate-CoA transferase subunit |
| acetoacetyl-CoA + acetate -> acetoacetate + acetyl-CoA | 2.8.3.8 | Acetyl-CoA: acetoacetate-CoA transferase subunit | atoD | Escherichia coli | Acetyl-CoA: acetoacetate-CoA transferase subunit |
| acetoacetate -> acetone + CO2 | 4.1.1.4 | acetoacetate decarboxylase | adc | Clostridium acetobutylicum | acetoacetate decarboxylase |
| acetoacetate -> acetone + CO2 | 4.1.1.4 | acetoacetate decarboxylase | adc | Clostridium beijerinckii | acetoacetate decarboxylase |
| acetone + acetyl-CoA + H2O <-> 3-hydroxy-isovalerate | 2.3.3.— | 3-hydroxy-isovalerate synthase | Hmgcs1 | Mus musculus | hydroxymethylglutaryl-CoA synthase |
| acetone + acetyl-CoA + H2O <-> 3-hydroxy-isovalerate | 2.3.3.— | 3-hydroxy-isovalerate synthase | ERG13 | Saccharomyces cerevisiae | hydroxymethylglutaryl-CoA synthase |
| acetone + acetyl-CoA + H2O <-> 3-hydroxy-isovalerate | 2.3.3.— | 3-hydroxy-isovalerate synthase | PksG | Lactobacillus crispatus ST1 | hydroxymethylglutaryl-CoA synthase/polyketide intermediate transferase |
| acetone + acetyl-CoA + H2O <-> 3-hydroxy-isovalerate | 2.3.3.— | 3-hydroxy-isovalerate synthase | Pnap_0477 | Polaromonas naphthalenivorans | hydroxymethylglutaryl-CoA lyase |
| 3-hydroxy-isovalerate + ATP <-> ADP + H(+) + 3-phosphonoxyisovalerate | 2.7.1.— | hydroxyisovalerate kinase | TA1305 | Thermoplasma acidophilum | mevalonate-diphosphate decarboxylase/ mevalonate-monophosphate decarboxylase |
| 3-hydroxy-isovalerate + ATP <-> ADP + H(+) + 3-phosphonoxyisovalerate | 2.7.1.— | hydroxyisovalerate kinase | TA1305* (L200E) | Thermoplasma acidophilum | mevalonate-diphosphate decarboxylase/ mevalonate-monophosphate decarboxylase |

TABLE 1-continued

| | | | | | |
|---|---|---|---|---|---|
| 3-hydroxy-isovalerate + ATP <-> ADP + H(+) + 3-phosphonoxyisovalerate | 2.7.1.— | hydroxyisovalerate kinase | PTO1356 | *Picrophilus torridus* | mevalonate-diphosphate decarboxylase |
| 3-phosphonoxyisovalerate -> CO(2) + isobutene | 4.1.1.— | 3-phosphonoxyisovalerate decarboxylase | smi_1746 | *Streptococcus mitis* | mevalonate-diphosphate decarboxylase |
| 3-phosphonoxyisovalerate -> CO(2) + isobutene | 4.1.1.— | 3-phosphonoxyisovalerate decarboxylase | mvaD | *Streptococcus gordonii* | mevalonate-diphosphate decarboxylase |
| 3-hydroxy-isovalerate -> CO(2) + isobutene | 4.1.1.— | hydroxyisovalerate decarboxylase | TA1305 | *Thermoplasma acidophilum* | mevalonate-diphosphate decarboxylase |
| 3-hydroxy-isovalerate -> CO(2) + isobutene | 4.1.1.— | hydroxyisovalerate decarboxylase | PTO1356 | *Picrophilus torridus* | mevalonate-diphosphate decarboxylase |
| 3-hydroxy-isovalerate -> CO(2) + isobutene | 4.1.1.— | hydroxyisovalerate decarboxylase | mvaD | *Streptococcus gordonii* | mevalonate-diphosphate decarboxylase |
| Hydrolases that may be used in improved acetone pathway to isobutene | | | | | |
| Acetoacetyl-CoA + H(2)O <=> CoA + acetoacetate | 3.1.2.11 | acetate:acetoacetyl-CoA hydrolase | ctfA | *Clostridium acetobutylicum* | butyrate-acetoacetate CoA-transferase, complex A |
| Acetoacetyl-CoA + H(2)O <=> CoA + acetoacetate | 3.1.2.11 | acetate:acetoacetyl-CoA hydrolase | ctfB | *Clostridium acetobutylicum* | butyrate-acetoacetate CoA-transferase, subunit B |
| Acetoacetyl-CoA + H(2)O <=> CoA + acetoacetate | 3.1.2.11 | acetate:acetoacetyl-CoA hydrolase | atoA | *Escherichia coli* (strain K12) | Acetyl-CoA:acetoacetate-CoA transferase subunit |
| Acetoacetyl-CoA + H(2)O <=> CoA + acetoacetate | 3.1.2.11 | acetate:acetoacetyl-CoA hydrolase | atoD | *Escherichia coli* (strain K12) | Acetyl-CoA:acetoacetate-CoA transferase subunit |
| Enzymes that may be used in HMG-CoA pathway to isobutene | | | | | |
| acetyl-CoA + H2O + acetoacetyl-CoA <=> (S)-3-hydroxy-3-methylglutaryl-CoA + CoA | 2.3.3.10 | HMG-CoA synthase | hmgS | *Saccharomyces cerevisiae* | HMG-CoA synthase |
| (S)-3-hydroxy-3-methylglutaryl-CoA <=> trans-3-methylglutaconyl-CoA + H(2)O | 4.2.1.18 | methylglutaconyl-CoA hydratase | liuC | *Pseudomonas putida* | methylglutaconyl-CoA hydratase |
| ADP + phosphate + 3-methylglutaconyl-CoA <=> ATP + 3-methylcrotonoyl-CoA + HCO(3)(−) | 6.4.1.4. | methylcrotonyl-CoA carboxylase | liuB | *Pseudomonas aeruginosa* | methylcrotonyl-CoA carboxylase subunit beta |
| ADP + phosphate + 3-methylglutaconyl-CoA <=> ATP + 3-methylcrotonoyl-CoA + HCO(3)(−) | 6.4.1.4. | methylcrotonyl-CoA carboxylase | liuD | *Pseudomonas aeruginosa* | methylcrotonyl-CoA carboxylase subunit alpha |
| trans-2(or 3)-enoyl-CoA + H(2)O <=> (3S)-3-hydroxyacyl-CoA | 4.2.1.17 | methylcrotonyl-CoA hydratase | fadA | *E. coli* | fatty acid oxidation complex, 3-ketoacyl-CoA thiolase |
| trans-2(or 3)-enoyl-CoA + H(2)O <=> (3S)-3-hydroxyacyl-CoA | 4.2.1.17 | methylcrotonyl-CoA hydratase | fadB | *E. coli* | fatty acid oxidation complex, enoyl-CoA hydratase |
| 3-hydroxy-isovaleryl-CoA + H2O <=> 3-hydroxy-isovalerate + CoA | 3.1.2.— | 3-hydroxy-isovaleryl-CoA thioesterase | tesB | *E. coli* | acyl-CoA thioesterase |
| Enzymes that may be used in 2-propanol (IPA) pathway via acetone | | | | | |
| acetone + NAD(P)H -> 2-propanol + NAD(P)+ | 1.1.1.2 | secondary alcohol dehydrogenase | adh | *Clostridium beijerinckii* | secondary alcohol dehydrogenase |
| acetone + NAD(P)H -> 2-propanol + NAD(P)+ | 1.1.1.2 | secondary alcohol dehydrogenase | adh | *Clostridium carboxidivorans* | alcohol dehydrogenase |
| NADH + NADP+ <--> NAD+ + NADPH | 1.6.1.1. | Soluble pyridine nucleotide transhydrogenase | udhA | *Escherichia coli* | Soluble pyridine nucleotide transhydrogenase |

TABLE 1-continued

Enzymes that may be used in pentose and/or hexose to
D-ribose-5-phosphate

| Reaction | EC | Enzyme | Gene | Organism | Description |
|---|---|---|---|---|---|
| ATP + D-xylulose = ADP + D-xylulose 5-phosphate | 2.7.1.17 | Xylulose 5-kinase | xylB | E. coli | Xylulose kinase |
| ATP + D-ribose = ADP + D-ribose 5-phosphate | | ribokinase | rbsK | E. coli | Pentose kinase |
| ATP + D-xylulose = ADP + D-xylulose 5-phosphate | | xylulokinase | XuK | Thermotoga maritima | Pentose kinase |
| ATP + D-ribulose = ADP + D-ribulose 5-phosphate | | ribulokinase | araB | E. coli | Pentose kinase |
| D-erythrose 4-phosphate + D-xylulose 5-phosphate ↔ β-D-fructofuranose 6-phosphate + D-glyceraldehyde 3-phosphate | 2.2.1.1 | Transketolase | tktA | E. coli | Transketolase |
| D-sedoheptulose 7-phosphate + D-glyceraldehyde 3-phosphate ↔ D-ribose 5-phosphate + D-xylulose 5-phosphate | 2.2.1.1 | Transketolase | tktA | E. coli | Transketolase |
| D-erythrose 4-phosphate + D-xylulose 5-phosphate ↔ β-D-fructofuranose 6-phosphate + D-glyceraldehyde 3-phosphate | 2.2.1.1 | Transketolase | tktB | E. coli | Transketolase |
| D-sedoheptulose 7-phosphate + D-glyceraldehyde 3-phosphate ↔ D-ribose 5-phosphate + D-xylulose 5-phosphate | 2.2.1.1 | Transketolase | tktB | E. coli | Transketolase |
| D-sedoheptulose 7-phosphate + D-glyceraldehyde 3-phosphate ↔ β-D-fructofuranose 6-phosphate + D-erythrose 4-phosphate | 2.2.1.2 | Transaldolase | talA | E. coli | Transaldolase |
| D-sedoheptulose 7-phosphate + D-glyceraldehyde 3-phosphate ↔ β-D-fructofuranose 6-phosphate + D-erythrose 4-phosphate | 2.2.1.2 | Transaldolase | talB | E. coli | Transaldolase |
| D-ribose 5-phosphate ↔ D-ribulose 5-phosphate | 5.3.1.6 | Ribose-5-phosphate isomerase | rpiA | E. coli | Ribose-5-phosphate isomerase |
| D-ribose 5-phosphate ↔ D-ribulose 5-phosphate | 5.3.1.6 | Ribose-5-phosphate isomerase | rpiB | E. coli | ibose-5-phosphate isomerase |
| D-ribulose 5-phosphate ↔ D-xylulose 5-phosphate | 5.1.3.1 | Ribulose-5-phosphate 3-epimerase | rpe | E. coli | Ribulose-5-phosphate 3-epimerase |
| D-fructose 6-phosphate + phosphate ↔ acetyl phosphate + D-erythrose 4-phosphate + H2O | 4.1.2.22 | fructose 6-phosphate phosphoketolase (Fpk) | BDP_1006 | Bifidobacterium dentium | fructose 6-phosphate phosphoketolase |
| D-fructose 6-phosphate + phosphate ↔ acetyl phosphate + D-erythrose 4-phosphate + H2O | 4.1.2.22 | fructose 6-phosphate phosphoketolase (Fpk) | xfp | Bifidobacterium lactis | Xylulose-5-phosphate/fructose-6-phosphate phosphoketolase |
| D-fructose 6-phosphate + phosphate ↔ acetyl phosphate + D-erythrose 4-phosphate + H2O | 4.1.2.22 | fructose 6-phosphate phosphoketolase (Fpk) | xpkA | Lactobacillus paraplantarum | phosphoketolase |

TABLE 1-continued

| Reaction | EC # | Enzyme name | Gene | Organism | Enzyme |
|---|---|---|---|---|---|
| D-fructose 6-phosphate + phosphate ↔ acetyl phosphate + D-erythrose 4-phosphate + H2O | 4.1.2.22 | fructose 6-phosphate phosphoketolase (Fpk) | xfp | *Bifidobacterium breve* | phosphoketolase |
| Acetyl-CoA + phosphate ↔ CoA + acetyl phosphate. | 2.3.1.8 | Phosphate acetyltransferase | pta | *E. coli* | Phosphate acetyltransferase |
| Acetyl-CoA + phosphate ↔ CoA + acetyl phosphate. | 2.3.1.8 | Phosphate acetyltransferase | pta | *Clostridium acetobutylicum* | Phosphate acetyltransferase |

Enzymes that may be used to convert D-ribose 5-phosphate, D-ribulose 5-phosphate or D-xylulose 5-phosphate to glycolaldehyde and glyceraldehyde-3-phosphate (G3P)

| Reaction | EC # | Enzyme name | Gene | Organism | Enzyme |
|---|---|---|---|---|---|
| D-ribose 5-phosphate → glycoladehyde + glyceraldehyde-3-phosphate | 4.1.2.4 | pentose-phosphate aldolase (DERA) | deoC | *E. coli* | Deoxyribose-phosphate aldolase |
| D-ribose 5-phosphate → glycoladehyde + glyceraldehyde-3-phosphate | 4.1.2.4 | pentose-phosphate aldolase (DERA) | deoC | *B. caldolyticus* | Deoxyribose-phosphate aldolase |

Enzymes that may be used in production of MEG, glycolic acid, and/or one or more co-products

| Reaction | EC # | Enzyme name | Gene | Organism | Enzyme |
|---|---|---|---|---|---|
| hydroxypyruvate + H+ ↔ CO2 + glycolaldehyde | 4.1.1.— | Hydroxypyruvate decarboxylase | kivd | *Lactococcus lactis* | α-ketoisovalerate decarboxylase |
| hydroxypyruvate + H+ ↔ CO2 + glycolaldehyde | 4.1.1.— | Hydroxypyruvate decarboxylase | sucA | *E. coli* | 2-oxoglutarate decarboxylase |
| 3-phospho-D-glycerate + NAD+ ↔ 3-phospho-hydroxypyruvate + NADH + H+ | 1.1.1.95 | D-3-phosphoglycerate dehydrogenase | serA | *E. coli* | D-3-phosphoglycerate dehydrogenase |
| 3-phospho-L-serine + 2-oxoglutarate ↔ L-glutamate + 3-phospho-hydroxypyruvate | 2.6.1.52 | Phosphoserine aminotransferase | serC | *E. coli* | Phosphoserine aminotransferase |
| 3-phospho-hydroxypyruvate + H2O → hydroxypyruvate + phosphate | — | 3-phosphohydroxy pyruvate phosphatase | yeaB (nudL) | *E. coli* | putative CoA pyrophosphohydrolase |
| 3-phospho-L-serine + H2O → L-serine + phosphate | 3.1.3.3 | Phosphoserine phosphatase | serB | *E. coli* | Phosphoserine phosphatase |
| L-serine + H+ → ethanolamine + CO2 | 4.1.1.65 | serine decarboxylase | AtSDC (AT1G43710) | *Arabidopsis thaliana* | serine decarboxylase |
| ethanolamine + oxygen + H2O → ammonium + hydrogen peroxide + glycolaldehyde | 1.4.3.8 | Ethanolamine oxidase | tynA | *E. coli* | amine oxidase |
| ethanolamine + 2-oxoglutarate → glycolaldehyde + L-glutamate | 2.6.1.— | Ethanolamine aminotransferase | alaA | *E. coli* | glutamate-pyruvate aminotransferase |
| D-glycerate + NAD(P)+ ↔ hydroxypyruvate + NAD(P)H + H+ | 1.1.1.— | Hydroxypyruvate reductase | ghrB | *E. coli* | glyoxylate reductase |
| pyruvate + L-serine ↔ L-alanine + hydroxypyruvate | 2.6.1.51 | serine-pyruvate aminotransferase | AGXT1 | *Homo sapiens* | serine-pyruvate aminotransferase |
| 3-phospho-D-glycerate + H2O → D-glycerate + phosphate | 3.1.3.38 | 3-phosphoglycerate phosphatase | phoA | *E. coli* | phosphoglycerate phosphatase |
| 2-phospho-D-glycerate + H2O → D-glycerate + phosphate | 3.1.3.20 | 2-phosphoglycerate phosphatase | phoA | *E. coli* | phosphoglycerate phosphatase |
| D-glycerate + ATP ↔ 3-phospho-D-glycerate + ADP + H+ | 2.7.1.31 | Glycerate 3-kinase | GLYK | *Arabidopsis thaliana* | Glycerate 3-kinase |
| D-glycerate + ATP ↔ 2-phospho-D-glycerate + ADP + H+ | 2.7.1.165 | Glycerate 2-kinase | glxK | *E. coli* | Glycerate 2-kinase |

TABLE 1-continued

| D-glycerate + ATP <=> 2-phospho-D-glycerate + ADP + H+ | 2.7.1.165 | Glycerate 2-kinase | garK | E. coli | Glycerate 2-kinase |
|---|---|---|---|---|---|

| Described Reaction | Gene Identifier (nt) | SEQ ID NO (nt) | Uniprot ID | SEQ ID NO (AA) |
|---|---|---|---|---|
| *Isomerases that may be used in conversion of D-xylose to D-xylulose* | | | | |
| D-xylopyranose <=> D-xylulose | ENA Nr.: CAB76571.1 | 93, 94 | Q9P8C9 | 95 |
| D-xylopyranose <=> D-xylulose | GeneID: 948141 | 143 | P00944 | 144 |
| *Glycolaldehyde reductases that may be used to convert glycolaldehyde to MEG* | | | | |
| glycolaldehyde + NAD(P)H <=> monoethylene glycol + NAD(P)+ | GeneID: 12933659 | 12 | P0A9S5 | 13 |
| glycolaldehyde + NAD(P)H <=> monoethylene glycol + NAD(P)+ | GeneID: 854014 | 14 | Q12068 | 15 |
| glycolaldehyde + NAD(P)H <=> monoethylene glycol + NAD(P)+ | GeneID: 856504 | 16 | P38715 | 17 |
| glycolaldehyde + NAD(P)H <=> monoethylene glycol + NAD(P)+ | GeneID: 947493 | 18, 19 | Modified version of Q46856; G149E | 20 |
| glycolaldehyde + NAD(P)H <=> monoethylene glycol + NAD(P)+ | GeneID: 947493 | 21, 22 | Q46856 | 23 |
| glycolaldehyde + NAD(P)H <=> monoethylene glycol + NAD(P)+ | GeneID: 12930149 | 24 | P77256 | 25 |
| glycolaldehyde + NAD(P)H <=> monoethylene glycol + NAD(P)+ | GeneID: 947273 | 26, 27 | P0A9S1 | 28 |
| glycolaldehyde + NAD(P)H <=> monoethylene glycol + NAD(P)+ | 545778205 | 29 | P30863 | 30 |
| glycolaldehyde + NAD(P)H <=> monoethylene glycol + NAD(P)+ | GeneID: 947495 | 31 | Q46857 | 32 |
| *Enzymes that may be used in 2-propanol (IPA) pathway via acetone or in acetone pathway to isobutene* | | | | |
| 2 acetyl-Coa -> acetoacetyl-CoA + CoA | 3309200 | 33, 34 | P45359 | 35 |
| 2 acetyl-Coa -> acetoacetyl-CoA + CoA | GeneID: 946727 | 36 | P76461 | 37 |
| 2 acetyl-Coa -> acetoacetyl-CoA + CoA | 856079 | 38 | P41338 | 39 |
| acetoacetyl-CoA + acetate -> acetoacetate + acetyl-CoA | 48994873 | 41, 42 | P76459 | 43 |
| acetoacetyl-CoA + acetate -> acetoacetate + acetyl-CoA | 48994873 | 44, 45 | P76458 | 46 |
| acetoacetate -> acetone + CO2 | 6466901 | 47, 48 | P23670 | 49 |
| acetoacetate -> acetone + CO2 | 149901357 | 50, 51 | A6M020 | 52 |
| acetone + acetyl-CoA + H2O <-> 3-hydroxy-isovalerate | CCDS56901.1; GeneID: 208715 | 104 | Q3UWQ9 | 105 |
| acetone + acetyl-CoA + H2O <-> 3-hydroxy-isovalerate | GeneID: 854913 | 106 | P54839 | 107 |

TABLE 1-continued

| | | | | |
|---|---|---|---|---|
| acetone +acetyl-CoA + H2O <-> 3-hydroxy-isovalerate | GeneID: 9107446 | 108 | AEL95_01455 | 109 |
| acetone + acetyl-CoA + H2O <-> 3-hydroxy-isovalerate | ABM35799.1 | 110 | A1VJH1 | 111 |
| 3-hydroxy-isovalerate + ATP <-> ADP + H(+) + 3-phosphonoxyisovalerate | GeneID: 1456782 | 112 | Q9HIN1 | 113 |
| 3-hydroxy-isovalerate + ATP <-> ADP + H(+) + 3-phosphonoxyisovalerate | GeneID: 1456782 | 114 | Modified version of Q9HIN1; L200E | 115 |
| 3-hydroxy-isovalerate + ATP <-> ADP + H(+) + 3-phosphonoxyisovalerate | GeneID: 2845209 | 116 | Q6KZB1 | 117 |
| 3-phosphonoxyisovalerate -> CO(2) + isobutene | Genbank: CBJ22986.1 | 118 | D3HAT7 | 119 |
| 3-phosphonoxyisovalerate -> CO(2) + isobutene | GeneID: 25051665 | 120 | A8AUU9 | 121 |
| 3-hydroxy-isovalerate -> CO(2) + isobutene | GeneID: 1456782 | 112 | Q9HIN1 | 113 |
| 3-hydroxy-isovalerate -> CO(2) + isobutene | GeneID: 2845209 | 116 | Q6KZB1 | 117 |
| 3-hydroxy-isovalerate -> CO(2) + isobutene | GeneID: 25051665 | 120 | A8AUU9 | 121 |
| Hydrolases that may be used in improved acetone pathway to isobutene | | | | |
| Acetoacetyl-CoA + H(2)O <=> CoA + acetoacetate | NCBI-GeneID: 1116168 | 96 | P33752 | 97 |
| Acetoacetyl-CoA + H(2)O <=> CoA + acetoacetate | NCBI-GeneID: 1116169 | 98 | P23673 | 99 |
| Acetoacetyl-CoA + H(2)O <=> CoA + acetoacetate | GeneID: 946719 | 100 | P76459 | 101 |
| Acetoacetyl-CoA + H(2)O <=> CoA + acetoacetate | GeneID: 947525 | 102 | P76458 | 103 |
| Enzymes that may be used in HMG-CoA pathway to isobutene | | | | |
| acetyl-CoA + H2O + acetoacetyl-CoA <=> (S)-3-hydroxy-3-methylglutaryl-CoA + CoA | GeneID: 854913 | 122 | P54839 | 123 |
| (S)-3-hydroxy-3-methylglutaryl-CoA <=> trans-3-methylglutaconyl-CoA + H(2)O | GeneID: 1041856 | 124 | Q88FM3 | 125 |
| ADP + phosphate + 3-methylglutaconyl-CoA <=> ATP + 3-methylcrotonoyl-CoA + HCO(3)(−) | GeneID: 878244 | 126 | Q9I297 | 127 |
| ADP + phosphate + 3-methylglutaconyl-CoA <=> ATP + 3-methylcrotonoyl-CoA + HCO(3)(−) | GeneID: 879012 | 128 | Q9I299 | 129 |
| trans-2(or 3)-enoyl-CoA + H(2)O <=> (3S)-3-hydroxyacyl-CoA | GeneID: 948324 | 130 | P21151 | 131 |
| trans-2(or 3)-enoyl-CoA + H(2)O <=> (3S)-3-hydroxyacyl-CoA | GeneID: 948336 | 132 | P21177 | 133 |
| 3-hydroxy-isovaleryl-CoA + H2O <=> 3-hydroxy-isovalerate + CoA | GeneID: 945074 | 134 | P0AGG2 | 135 |

TABLE 1-continued

| Enzymes that may be used in 2-propanol (IPA) pathway via acetone | | | | |
|---|---|---|---|---|
| acetone + NAD(P)H –> 2-propanol + NAD(P)+ | 60592972 | 136,137 | P25984 | 138 |
| acetone + NAD(P)H –> 2-propanol + NAD(P)+ | 308066805 | 139 | C6PZV5 | 140 |
| NADH + NADP+ <--> NAD+ + NADPH | GeneID: 948461 | 141 | P27306 | 142 |
| Enzymes that may be used in pentose and/or hexose to D-ribose-5-phosphate | | | | |
| ATP + D-xylulose = ADP + D-xylulose 5-phosphate | GeneID: 948133 | 145 | P09099 | 146 |
| ATP + D-ribose = ADP + D-ribose 5-phosphate | 948260 | 290 | P0A9J6 | |
| ATP + D-xylulose = ADP + D-xylulose 5-phosphate | 896943 | 291 | Q9WXX1 | |
| ATP + D-ribulose = ADP + D-ribulose 5-phosphate | 946017 | 288 | P08204 | |
| D-erythrose 4-phosphate + D-xylulose 5-phosphate ↔ β-D-fructofuranose 6-phosphate + D-glyceraldehyde 3-phosphate | GeneID: 947420 | 147 | P27302 | 148 |
| D-sedoheptulose 7-phosphate + D-glyceraldehyde 3-phosphate ↔ D-ribose 5-phosphate + D-xylulose 5-phosphate | GeneID: 947420 | 147 | P27302 | 148 |
| D-erythrose 4-phosphate + D-xylulose 5-phosphate ↔ β-D-fructofuranose 6-phosphate + D-glyceraldehyde 3-phosphate | GeneID: 945865 | 149 | P33570 | 150 |
| D-sedoheptulose 7-phosphate + D-glyceraldehyde 3-phosphate ↔ D-ribose 5-phosphate + D-xylulose 5-phosphate | GeneID: 945865 | 149 | P33570 | 150 |
| D-sedoheptulose 7-phosphate + D-glyceraldehyde 3-phosphate ↔ β-D-fructofuranose 6-phosphate + D-erythrose 4-phosphate | GeneID: 947006 | 151 | P0A867 | 152 |
| D-sedoheptulose 7-phosphate + D-glyceraldehyde 3-phosphate ↔ β-D-fructofuranose 6-phosphate + D-erythrose 4-phosphate | GeneID: 944748 | 153 | P0A870 | 154 |
| D-ribose 5-phosphate ↔ D-ribulose 5-phosphate | GeneID: 947407 | 155 | P0A7Z0 | 156 |
| D-ribose 5-phosphate ↔ D-ribulose 5-phosphate | GeneID: 948602 | 254 | P37351 | 253 |
| D-ribulose 5-phosphate ↔ D-xylulose 5-phosphate | GeneID: 947896 | 157 | P0AG07 | 158 |
| D-fructose 6-phosphate + phosphate ↔ acetyl phosphate + D-erythrose 4-phosphate + H2O | EMBL: ADB09649.1 | 211 | D2QA13 | 212 |

TABLE 1-continued

| | | | | |
|---|---|---|---|---|
| D-fructose 6-phosphate + phosphate ↔ acetyl phosphate + D-erythrose 4-phosphate + H2O | GeneID: 29696432 | 213 | Q9AEM9 | 214 |
| D-fructose 6-phosphate + phosphate ↔ acetyl phosphate + D-erythrose 4-phosphate + H2O | EMBL: AAQ64626.2 | 215 | Q6UPD8 | 216 |
| D-fructose 6-phosphate + phosphate ↔ acetyl phosphate + D-erythrose 4-phosphate + H2O | EMBL: ADF97524.1 | 217 | D6PAH1 | 218 |
| Acetyl-CoA + phosphate ↔ CoA + acetyl phosphate. | GeneID: 946778 | 219 | P0A9M8 | 220 |
| Acetyl-CoA + phosphate ↔ CoA + acetyl phosphate. | GeneID: 1117925 | 221 | P71103 | 222 |
| Enzymes that may be used to convert D-ribose 5-phosphate, D-ribulose 5-phosphate or D-xylulose 5-phosphate to glycolaldehyde and glyceraldehyde-3-phosphate (G3P) | | | | |
| D-ribose 5-phosphate → glycoladehyde + glyceraldehyde-3-phosphate | GenBank: 948902 | 255 | P0A6L0 | 256 |
| D-ribose 5-phosphate → glycoladehyde + glyceraldehyde-3-phosphate | | 286 or 287 | A0A2H5KL15 | |
| Enzymes that may be used in production of MEG, glycolic acid, and/or one or more co-products | | | | |
| hydroxypyruvate + H+ ↔ CO2 + glycolaldehyde | GenBank: AJ746364.1 | 223 | Q684J7 | 224 |
| hydroxypyruvate + H+ ↔ CO2 + glycolaldehyde | GeneID: 945303 | 225 | P0AFG3 | 226 |
| 3-phospho-D-glycerate + NAD+ ↔ 3-phospho-hydroxypyruvate + NADH + H+ | GeneID: 945258 | 227 | P0A9T0 | 228 |
| 3-phospho-L-serine + 2-oxoglutarate ↔ L-glutamate + 3-phospho-hydroxypyruvate | GeneID: 945527 | 229 | P23721 | 230 |
| 3-phospho-hydroxypyruvate + H2O → hydroxypyruvate + phosphate | GeneID: 946330 | 231 | P43337 | 232 |
| 3-phospho-L-serine + H2O → L-serine + phosphate | GeneID: 948913 | 233 | P0AGB0 | 234 |
| L-serine + H+ → ethanolamine + CO2 | GeneID: 840958 | 235 | Q9MA74 | 236 |
| ethanolamine + oxygen + H2O → ammonium + hydrogen peroxide + glycolaldehyde | GeneID: 945939 | 237 | P46883 | 238 |
| ethanolamine + 2-oxoglutarate → glycolaldehyde + L-glutamate | GeneID: 946772 | 239 | P0A959 | 240 |
| D-glycerate + NAD(P)+ ↔ hydroxypyruvate + NAD(P)H + H+ | GeneID: 948074 | 241 | P37666 | 242 |
| pyruvate + L-serine ↔ L-alanine + hydroxypyruvate | Gene ID: 189, CCDS2543.1 | 243 | P21549 | 244 |
| 3-phospho-D-glycerate + H2O → D-glycerate + phosphate | GeneID: 945041 | 245 | P00634 | 246 |

TABLE 1-continued

| | | | | |
|---|---|---|---|---|
| 2-phospho-D-glycerate + H2O → D-glycerate + phosphate | GeneID: 945041 | 245 | P00634 | 246 |
| D-glycerate + ATP ↔ 3-phospho-D-glycerate + ADP + H+ | GeneID: 844378, mRNA NM_179581.2 | 247 | Q944I4 | 248 |
| D-glycerate + ATP ↔ 2-phospho-D-glycerate + ADP + H+ | GeneID: 945129 | 249 | P77364 | 250 |
| D-glycerate + ATP ↔ 2-phospho-D-glycerate + ADP + H+ | GeneID: 947632 | 251 | P23524 | 252 |

Glycolaldehyde Reductase (EC 1.1.1.77)

The present disclosure describes enzymes that can catalyze the following reversible reactions:

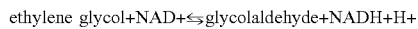

ethylene glycol+NAD+⇌glycolaldehyde+NADH+H+

(S)-propane-1,2-diol+NAD+⇌(S)-lactaldehyde+NADH+H+

Glycolaldehyde reductase may also be known as lactaldehyde reductase, propanediol oxidoreductase, (R) [or(S)]-propane-1,2-diol:NAD+ oxidoreductase or L-1,2-propanediol oxidoreductase.

Thus, in some embodiments, the disclosure provides for an enzyme that plays roles in the ethylene glycol degradation pathway, the super pathway of glycol metabolism and degradation, the anaerobic L-lactaldehyde degradation pathway and/or the super pathway of fucose and rhamnose degradation. In one embodiment, the enzyme may use $Fe^{2+}$ as a cofactor.

L-1,2-propanediol oxidoreductase is an iron-dependent group III dehydrogenase. It anaerobically reduces L-lactaldehyde, a product of both the L-fucose and L-rhamnose catabolic pathways, to L-1,2-propanediol, which is then excreted from the cell.

Crystal structures of the enzyme have been solved, showing a domain-swapped dimer in which the metal, cofactor and substrate binding sites could be located. An aspartate and three conserved histidine residues are required for $Fe^{2+}$ binding and enzymatic activity.

In vitro, the enzyme can be reactivated by high concentrations of NAD+ and efficiently inactivated by a mixture of $Fe^{3+}$ and ascorbate or $Fe^{2+}$ and $H_2O_2$. Metal-catalyzed oxidation of the conserved His277 residue is proposed to be the cause of the inactivation.

Expression of FucO enables engineered one-turn reversal of the β-oxidation cycle. FucO activity contributes to the conversion of isobutyraldehyde to isobutanol in an engineered strain.

In particular embodiments, the enzyme converts glycolaldehyde to MEG. In some embodiments, the glycolaldehyde reductase is from *Escherichia coli*. In some embodiments, the glycolaldehyde reductase is encoded by the fucO gene.

In one embodiment, the glycolaldehyde reductase is encoded by one or more nucleic acid molecules obtained from a microorganism selected from *E. coli* and *S. cerevisiae*. In another embodiment, the one or more nucleic acid molecules is selected from gldA, GRE2, GRE3, yqhD, ydjG, fucO, yafB (dkgB), and/or yqhE (dkgA), or homolog thereof. In another embodiment, the one or more nucleic acid molecules is yqhD. In some embodiments, the yqhD comprises a G149E mutation. In a further embodiment, the glycolaldehyde reductase comprises an amino acid sequence selected from the group consisting of SEQ ID NOs: 13, 15, 17, 20, 23, 25, 28, 30 and 32. In yet a further embodiment, the glycolaldehyde reductase is encoded by a nucleic acid sequence selected from the group consisting of SEQ ID NOs: 12, 14, 16, 18, 19, 21, 22, 24, 26, 27, 29 and 31.

In some embodiments, a recombinant microorganism producing glycolic acid comprises a deletion, insertion, or loss of function mutation in a gene encoding an enzyme having glycolaldehyde reductase activity to prevent the conversion of glycolaldehyde to monoethyleneglycol (MEG) and instead shunt the reaction toward conversion of glycolaldehyde to glycolic acid (GA). In some embodiments, the enzyme having glycolaldehyde reductase activity is from *Escherichia coli*. In some embodiments, the enzyme having glycolaldehyde reductase activity is encoded by the fucO gene, or homolog thereof.

Aldehyde Reductases

A number of aldehyde reductases may be used to convert glycolaldehyde to MEG.

An NADPH-dependent aldehyde reductase (YqhD) can catalyze the following reactions:

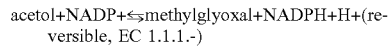

acetol+NADP+⇌methylglyoxal+NADPH+H+(reversible, EC 1.1.1.-)

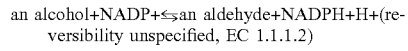

an alcohol+NADP+⇌an aldehyde+NADPH+H+(reversibility unspecified, EC 1.1.1.2)

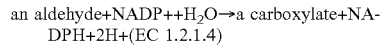

an aldehyde+NADP++H₂O→a carboxylate+NADPH+2H+(EC 1.2.1.4)

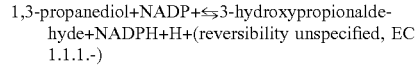

1,3-propanediol+NADP+⇌3-hydroxypropionaldehyde+NADPH+H+(reversibility unspecified, EC 1.1.1.-)

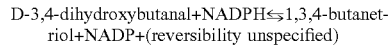

D-3,4-dihydroxybutanal+NADPH⇌1,3,4-butanetriol+NADP+(reversibility unspecified)

YqhD is an NADPH-dependent aldehyde reductase that may be involved in glyoxal detoxification and/or be part of a glutathione-independent response to lipid peroxidation.

It has been reported that various alcohols, aldehydes, amino acids, sugars and α-hydroxy acids have been tested as substrates for YqhD. The purified protein only shows NADP-dependent alcohol dehydrogenase activity, with a preference for alcohols longer than C(3), but with Km values in the millimolar range, suggesting that they are not the physiological substrates. In contrast, YqhD does exhibit short-chain aldehyde reductase activity with substrates such as propanaldehyde, acetaldehyde, and butanaldehyde, as well as acrolein and malondialdehyde. In a metabolically engineered strain, phenylacetaldehyde and 4-hydroxyphenylacetaldehyde are reduced to 2-phenylethanol and 2-(4-hydroxyphenyl)ethanol by the endogenous aldehyde reductases YqhD, YjgB, and YahK.

Overexpression of YqhD increases 1,3-propanediol oxidoreductase activity of the cell. *E. coli* has been engineered to express YqhD for the industrial production of 1,3-propanediol. YqhD activity contributes to the production of isobutanol, 1,2-propanediol, 1,2,4-butanetriol and acetol as well. Mutation of yqhD enables production of butanol by an engineered one-turn reversal of the β-oxidation cycle.

YqhD has furfural reductase activity, which appears to cause growth inhibition due to depletion of NADPH in metabolically engineered strains that produce alcohol from lignocellulosic biomass.

The crystal structure of YqhD has been solved at 2 Å resolution. YqhD is an asymmetric dimer of dimers, and the active site contains a $Zn^{2+}$ ion. The NADPH cofactor is modified by hydroxyl groups at positions 5 and 6 in the nicotinamide ring.

Overexpression of yqhD leads to increased resistance to reactive oxygen-generating compounds such as hydrogen peroxide, paraquat, chromate and potassium tellurite. A yqhD deletion mutant shows increased sensitivity to these compounds and to glyoxal, and contains increased levels of reactive aldehydes that are generated during lipid peroxidation. Conversely, yqhD deletion leads to increased furfural tolerance.

In particular embodiments, an NADPH-dependent aldehyde reductase converts glycolaldehyde to MEG. In some embodiments, the NADPH-dependent aldehyde reductase is from *Escherichia coli*. In some embodiments, the NADPH-dependent aldehyde reductase is encoded by the yqhD gene.

A multi-functional methylglyoxal reductase (DkgA) can catalyze the following reactions:

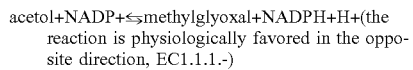
acetol+NADP+⇌methylglyoxal+NADPH+H+(the reaction is physiologically favored in the opposite direction, EC1.1.1.-)

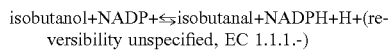
isobutanol+NADP+⇌isobutanal+NADPH+H+(reversibility unspecified, EC 1.1.1.-)

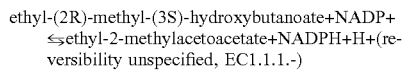
ethyl-(2R)-methyl-(3S)-hydroxybutanoate+NADP+⇌ethyl-2-methylacetoacetate+NADPH+H+(reversibility unspecified, EC1.1.1.-)

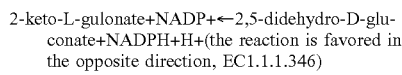
2-keto-L-gulonate+NADP+←2,5-didehydro-D-gluconate+NADPH+H+(the reaction is favored in the opposite direction, EC1.1.1.346)

DkgA (YqhE) belongs to the aldo-keto reductase (AKR) family and has been shown to have methylglyoxal reductase and beta-keto ester reductase activity.

dkgA is reported to encode a 2,5-diketo-D-gluconate reductase (25DKGR) A, one of two 25DKG reductases in *E. coli*. The enzyme uses NADPH as the preferred electron donor and is thought to be involved in ketogluconate metabolism. The specific activity of the enzyme towards 2,5-diketo-D-gluconate is reported to be almost 1000-fold lower than its activity towards methylglyoxal.

Due to its low Km for NADPH, reduction of furans by DkgA may deplete NADPH pools and thereby limit cellular biosynthesis. A broad survey of aldehyde reductases showed that DkgA was one of several endogenous aldehyde reductases that contribute to the degradation of desired aldehyde end products of metabolic engineering.

A crystal structure of DkgA has been solved at 2.16 Å resolution.

In particular embodiments, a multi-functional methylglyoxal reductase converts glycolaldehyde to MEG. In some embodiments, the multi-functional methylglyoxal reductase is from *Escherichia coli*. In some embodiments, the multi-functional methylglyoxal reductase is encoded by the dkgA gene.

A multi-functional methylglyoxal reductase (DkgB) can catalyze the following reactions:

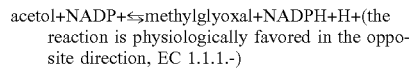
acetol+NADP+⇌methylglyoxal+NADPH+H+(the reaction is physiologically favored in the opposite direction, EC 1.1.1.-)

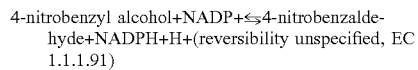
4-nitrobenzyl alcohol+NADP+⇌4-nitrobenzaldehyde+NADPH+H+(reversibility unspecified, EC 1.1.1.91)

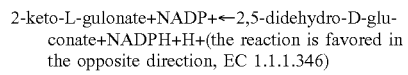
2-keto-L-gulonate+NADP+←2,5-didehydro-D-gluconate+NADPH+H+(the reaction is favored in the opposite direction, EC 1.1.1.346)

DkgB (YafB) is a member of the aldo-keto reductase (AKR) subfamily 3F. DkgB was shown to have 2,5-diketo-D-gluconate reductase, methylglyoxal reductase and 4-nitrobenzaldehyde reductase activities.

dkgB is reported to encode 2,5-diketo-D-gluconate reductase (25DKGR) B, one of two 25DKG reductases in *E. coli*. The enzyme uses NADPH as the preferred electron donor and is thought to be involved in ketogluconate metabolism. However, the specific activity of the enzyme towards 2,5-diketo-D-gluconate is reported to be almost 1000-fold lower than its activity towards methylglyoxal.

In particular embodiments, a multi-functional methylglyoxal reductase converts glycolaldehyde to MEG. In some embodiments, the multi-functional methylglyoxal reductase is from *Escherichia coli*. In some embodiments, the multi-functional methylglyoxal reductase is encoded by the dkgB gene.

A methylglyoxal reductase (YeaE) can catalyze the following reaction:

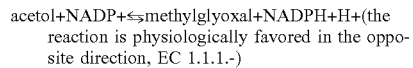
acetol+NADP+⇌methylglyoxal+NADPH+H+(the reaction is physiologically favored in the opposite direction, EC 1.1.1.-)

YeaE has been shown to have methylglyoxal reductase activity.

The subunit structure of YeaE has not been determined, but its amino acid sequence similarity to the aldo-keto reductases DkgA (YqhE) and DkgB (YafB) suggests that it may be monomeric.

In particular embodiments, a methylglyoxal reductase converts glycolaldehyde to MEG. In some embodiments, the methylglyoxal reductase is from *Escherichia coli*. In some embodiments, the methylglyoxal reductase is encoded by the yeaE gene.

A L-glyceraldehyde 3-phosphate reductase (yghZ) can catalyze the following reactions:

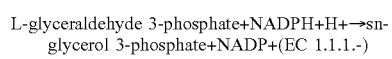
L-glyceraldehyde 3-phosphate+NADPH+H+→sn-glycerol 3-phosphate+NADP+(EC 1.1.1.-)

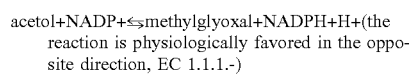
acetol+NADP+⇌methylglyoxal+NADPH+H+(the reaction is physiologically favored in the opposite direction, EC 1.1.1.-)

YghZ is an L-glyceraldehyde 3-phosphate (L-GAP) reductase. The enzyme is also able to detoxify methylglyoxal at a low rate. YghZ defines the AKR14 (aldo-keto reductase 14) protein family.

L-GAP is not a natural metabolite and is toxic to *E. coli*. L-GAP is a substrate of both the glycerol-3-phosphate and hexose phosphate transport systems of *E. coli* K-12. It has been postulated that the physiological role of YghZ is the detoxification of L-GAP, which may be formed by non-enzymatic racemization of GAP or by an unknown cellular process.

The crystal structure of the *E. coli* enzyme has been determined and is suggested to be a tetramer. However, others have found that the protein forms an octamer based on gel filtration and electron microscopy studies.

In particular embodiments, a L-glyceraldehyde 3-phosphate reductase converts glycolaldehyde to MEG. In some embodiments, the L-glyceraldehyde 3-phosphate reductase is from *Escherichia coli*. In some embodiments, the L-glyceraldehyde 3-phosphate reductase is encoded by the yghZ gene.

An L-1,2-propanediol dehydrogenase/glycerol dehydrogenase (GldA) can catalyze the following reactions:

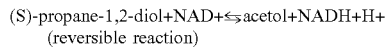
(S)-propane-1,2-diol+NAD+⇌acetol+NADH+H+
(reversible reaction)

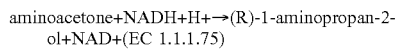
aminoacetone+NADH+H+→(R)-1-aminopropan-2-ol+NAD+(EC 1.1.1.75)

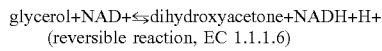
glycerol+NAD+⇌dihydroxyacetone+NADH+H+
(reversible reaction, EC 1.1.1.6)

The physiological function of the GldA enzyme has long been unclear. The enzyme was independently isolated as a glycerol dehydrogenase and a D-1-amino-2-propanol: NAD+ oxidoreductase. At that time, D-1-amino-2-propanol was thought to be an intermediate for the biosynthesis of vitamin B12, and although *E. coli* is unable to synthesize vitamin B12 de novo, enzymes catalyzing the synthesis of this compound were sought. It was later found that GldA was responsible for both activities.

The primary in vivo role of GldA was recently proposed to be the removal of dihydroxyacetone by converting it to glycerol. However, a dual role in the fermentation of glycerol has also recently been established. Glycerol dissimilation in *E. coli* can be accomplished by two different pathways. The glycerol and glycerophosphodiester degradation pathway requires the presence of a terminal electron acceptor and utilizes an ATP-dependent kinase of the Glp system, which phosphorylates glycerol to glycerol-3-phosphate. However, upon inactivation of the kinase and selection for growth on glycerol, it was found that an NAD+-linked dehydrogenase, GldA, was able to support glycerol fermentation. Recently, it was shown that GldA was involved in glycerol fermentation both as a glycerol dehydrogenase, producing dihydroxyacetone, and as a 1,2-propanediol dehydrogenase, regenerating NAD+ by producing 1,2-propanediol from acetol.

The enzyme is found in two catalytically active forms, a large form of eight subunits and a small form of two subunits. The large form appears to be the major species.

In particular embodiments, an L-1,2-propanediol dehydrogenase/glycerol dehydrogenase converts glycolaldehyde to MEG. In some embodiments, the L-1,2-propanediol dehydrogenase/glycerol dehydrogenase is from *Escherichia coli*. In some embodiments, the L-1,2-propanediol dehydrogenase/glycerol dehydrogenase is encoded by the gldA gene.

An NADPH-dependent methylglyoxal reductase (GRE2) from *Saccharomyces cerevisiae* can catalyze the following reactions:

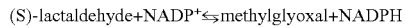
(S)-lactaldehyde+NADP+⇌methylglyoxal+NADPH

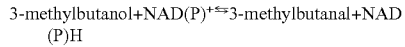
3-methylbutanol+NAD(P)+⇌3-methylbutanal+NAD(P)H

Gre2 is a versatile enzyme that catalyzes the stereoselective reduction of a broad range of substrates including aliphatic and aromatic ketones, diketones, as well as aldehydes, using NADPH as the cofactor.

The crystal structures of Gre2 from *S. cerevisiae* in an apo-form at 2.00 Å and NADPH-complexed form at 2.40 Å resolution have been solved. Gre2 forms a homodimer, each subunit of which contains an N-terminal Rossmann-fold domain and a variable C-terminal domain, which participates in substrate recognition. The induced fit upon binding to the cofactor NADPH makes the two domains shift toward each other, producing an interdomain cleft that better fits the substrate. Computational simulation combined with site-directed mutagenesis and enzymatic activity analysis enabled characterization of a potential substrate-binding pocket that determines the stringent substrate stereoselectivity for catalysis.

Gre2 catalyzes the irreversible reduction of the cytotoxic compound methylglyoxal (MG) to (S)-lactaldehyde as an alternative to detoxification of MG by glyoxalase I GLO1. MG is synthesized via a bypath of glycolysis from dihydroxyacetone phosphate and is believed to play a role in cell cycle regulation and stress adaptation. GRE2 also catalyzes the reduction of isovaleraldehyde to isoamylalcohol. The enzyme serves to suppress isoamylalcohol-induced filamentation by modulating the levels of isovaleraldehyde, the signal to which cells respond by filamentation. GRE2 is also involved in ergosterol metabolism.

In particular embodiments, an NADPH-dependent methylglyoxal reductase converts glycolaldehyde to MEG. In some embodiments, the NADPH-dependent methylglyoxal reductase is from *S. cerevisiae*. In some embodiments, the NADPH-dependent methylglyoxal reductase is encoded by the GRE2 gene.

Thiolase/Acetyl Coenzyme A Acetyltransferase (EC 2.3.1.9)

The present disclosure describes enzymes that can catalyze the following reaction:

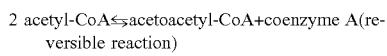
2 acetyl-CoA⇌acetoacetyl-CoA+coenzyme A (reversible reaction)

Thiolase/Acetyl coenzyme A acetyltransferase may also be known as acetyl-CoA-C-acetyltransferase, acetoacetyl-CoA thiolase, acetyl-CoA:acetyl-CoA C-acetyltransferase or thiolase II.

Thus, in some embodiments, the disclosure provides for an enzyme that plays a role in acetoacetate degradation (to acetyl CoA). In one embodiment, an inhibitor of this enzyme may be acetoacetyl-CoA.

In particular embodiments, the enzyme converts acetyl-CoA to acetoacetyl-CoA. In one embodiment, the thiolase or acetyl coenzyme A acetyltransferase is encoded by one or more nucleic acid molecules obtained from a microorganism selected from the group consisting of *Clostridium* sp., *Bacillus* sp., *E. coli*, *Saccharomyces* sp. and *Marinobacter* sp. In some embodiments, the thiolase or acetyl coenzyme A acetyltransferase is encoded by one or more nucleic acid molecules obtained from a microorganism selected from the group consisting of *Clostridium acetobutylicum*, *Clostridium thermosaccharolyticum*, *Bacillus cereus*, *E. coli*, *Saccharomyces cerevisiae* and *Marinobacter hydrocarbonoclasticus*. In some embodiments, the one or more nucleic acid molecules is thlA, atoB and/or ERG10, or homolog thereof. In a further embodiment, the thiolase or acetyl coenzyme A acetyltransferase comprises an amino acid sequence selected from the group consisting of SEQ ID NOs: 35, 37 and 40. In yet a further embodiment, the thiolase or acetyl coenzyme A acetyltransferase is encoded by a nucleic acid sequence selected from the group consisting of SEQ ID NOs: 33, 34, 36, 38 and 39.

Acetyl-CoA:Acetoacetate-CoA Transferase (EC 2.8.3.-)

The present disclosure describes enzymes that can catalyze the following reaction:

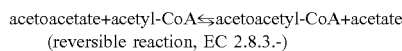
(reversible reaction, EC 2.8.3.-)

Acetyl-CoA:acetoacetate-CoA transferase may also be known as acetate:acetoacetyl-CoA transferase or acetoacetyl-CoA transferase.

Thus, in some embodiments, the disclosure provides for an enzyme that plays a role in acetoacetate degradation (to acetyl CoA). In one embodiment, inhibitors of this enzyme may include acetyl-CoA and coenzyme A.

The growth of *E. coli* on short-chain fatty acids (C3-C6) requires the activation of the acids to their respective thioesters. This activation is catalyzed by acetoacetyl-CoA transferase. The reaction takes place in two half-reactions which involves a covalent enzyme-CoA. The enzyme undergoes two detectable conformational changes during the reaction. It is thought likely that the reaction proceeds by a ping-pong mechanism. The enzyme can utilize a variety of short-chain acyl-CoA and carboxylic acid substrates but exhibits maximal activity with normal and 3-keto substrates.

In particular embodiments, the enzyme converts acetoacetyl-CoA to acetoacetate. In some embodiments, the acetyl-CoA:acetoacetate-CoA transferase is from *Clostridium* spp. In some embodiments, the acetyl-CoA:acetoacetate-CoA transferase is from *Clostridium acetobutylicum*. In some embodiments, the acetyl-CoA:acetoacetate-CoA transferase is from *Escherichia coli*. In some embodiments, the acetyl-CoA:acetoacetate-CoA transferase is encoded by the atoA and atoD genes. In another embodiment, the subunit composition of acetoacetyl-CoA transferase is [(AtoA)$_2$][(AtoD)$_2$], with (AtoA)$_2$ being the β complex and (AtoD)$_2$ being the α complex. In one embodiment, the acetyl-CoA:acetoacetate-CoA transferase is a fused acetyl-CoA:acetoacetate-CoA transferase: α subunit/β subunit. In another embodiment, the acetyl-CoA:acetoacetate-CoA transferase is encoded by the ydiF gene.

Acetate:Acetoacetvl-CoA Hydrolase (EC 3.1.2.11)

The present disclosure describes enzymes that can catalyze the following reaction:

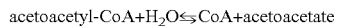

Acetoacetyl-CoA hydrolase may also be known as acetoacetyl coenzyme A hydrolase, acetoacetyl CoA deacylase or acetoacetyl coenzyme A deacylase.

This enzyme belongs to the family of hydrolases, specifically those acting on thioester bonds.

In particular embodiments, the enzyme converts acetoacetyl-CoA to acetoacetate. In some embodiments, the acetate:acetoacetyl-CoA hydrolase is from *Clostridium* spp. In some embodiments, the acetate:acetoacetyl-CoA hydrolase is from *Clostridium acetobutylicum*. In another embodiment, the Acetoacetyl-CoA hydrolase is encoded by the ctfA (subunit A) and/or ctfB (subunit B) genes.

In a further embodiment, the acetyl-CoA:acetoacetate-CoA transferase or acetate:acetoacetyl-CoA hydrolase comprises an amino acid sequence selected from the group consisting of SEQ ID NOs: 43, 46, 97, 99, 101 and 103. In yet a further embodiment, the acetyl-CoA:acetoacetate-CoA transferase or acetate:acetoacetyl-CoA hydrolase is encoded by a nucleic acid sequence selected from the group consisting of SEQ ID NOs: 41, 42, 44, 45, 96, 98, 100 and 102.

Acetoacetate Decarboxylase (EC 4.1.1.4)

The present disclosure describes enzymes that can catalyze the following reaction:

Acetoacetate decarboxylase may also be known as ADC, AADC or acetoacetate carboxy-lyase.

Thus, in some embodiments, the disclosure provides for an enzyme that plays roles in isopropanol biosynthesis, pyruvate fermentation to acetone, the super pathway of *Clostridium acetobutylicum* acidogenic and solventogenic fermentation and/or the super pathway of *Clostridium acetobutylicum* solventogenic fermentation.

Acetoacetate decarboxylase (ADC) plays a key role in solvent production in *Clostridium acetobutylicum*. During the acidogenic phase of growth, acids accumulate causing a metabolic shift to solvent production. In this phase acids are re-assimilated and metabolized to produce acetone, butanol and ethanol.

Preliminary purification and crystallization of the enzyme has revealed that a lysine residue is implicated in the active site. The enzyme is a large complex composed of 12 copies of a single type of subunit.

The enzyme of *Clostridium acetobutylicum* ATCC 824 has been purified and the adc gene encoding it cloned. The enzyme has also been purified from the related strain *Clostridium acetobutylicum* DSM 792 and the gene cloned and sequenced. The decarboxylation reaction proceeds by the formation of a Schiff base intermediate.

ADC is a key enzyme in acid uptake, effectively pulling the CoA-transferase reaction in the direction of acetoacetate formation.

In particular embodiments, the enzyme converts acetoacetate to acetone. In one embodiment, the acetoacetate decarboxylase is encoded by one or more nucleic acid molecules obtained from a microorganism selected from the group consisting of *Clostridium* sp., *Bacillus* sp., *Chromobacterium* sp. and *Pseudomonas* sp. In another embodiment, the acetoacetate decarboxylase is encoded by one or more nucleic acid molecules obtained from a microorganism selected from the group consisting of *Clostridium acetobutylicum*, *Clostridium beijerinckii*, *Clostridium cellulolyticum*, *Bacillus polymyxa*, *Chromobacterium violaceum* and *Pseudomonas putida*. In some embodiments, the one or more nucleic acid molecules encoding the acetoacetate decarboxylase is adc, or homolog thereof. In a further embodiment, the acetoacetate decarboxylase comprises an amino acid sequence selected from the group consisting of SEQ ID NOs: 49 and 52. In yet another embodiment, the acetoacetate decarboxylase is encoded by a nucleic acid sequence selected from the group consisting of SEQ ID NOs: 47, 48, 50 and 51.

Alcohol Dehydrogenase (EC 1.1.1.-)

The present disclosure describes enzymes that can catalyze the reversible oxidation of primary or secondary alcohols to aldehydes or ketones, respectively. In one embodiment, the enzyme is a secondary alcohol dehydrogenase (S-ADH) and catalyzes the reduction of ketones such as acetone into secondary alcohols such as 2-propanol (isopropanol).

In some embodiments the S-ADH is from *Burkholderia* sp. In some embodiments, the S-ADH is from *Burkholderia* sp. AIU 652. In some embodiments, the S-ADH is from *Alcaligenes* sp. In some embodiments, the S-ADH is from *Alcaligenes eutrophus*. In some embodiments, the S-ADH is from *Clostridium* sp. In some embodiments, the S-ADH is from *Clostridium ragsdalei*. In some embodiments, the S-ADH is from *Clostridium beijerinckii*. In some embodiments, the S-ADH is from *Thermoanaerobacter*sp. In some embodiments, the S-ADH is from *Thermoanaerobacter brockii*. In some embodiments, the S-ADH is from *Thermoanaerobacter ethanolicus* (*Clostridium thermohydrosulfuricum*). In some embodiments, the S-ADH is encoded by the adhB gene. In some embodiments, the S-ADH is from the trypanosomatid *Phytomonas* sp. In some embodiments, the S-ADH is from *Rhodococcus* sp. In some embodiments, the S-ADH is from *Rhodococcus ruber*. In some embodiments, the S-ADH is from *Methanobacterium palustre*. In some embodiments, the S-ADH is from methanogenic archaea *Methanogenium liminatans*. In some embodiments, the S-ADH is from the parasitic protist *Entamoeba histolytica* (EhAdh1). In some embodiments, the S-ADH is from parasitic protozoan *Tritrichomonas foetus*. In some embodiments, the S-ADH is from human parasite *Trichomonas vaginalis*.

In some embodiments, the S-ADH is predicted from homology and can be from *Thermoanaerobacter mathranii*, *Micrococcus luteus, Nocardiopsis alba, Mycobacterium hassiacum, Helicobacter suis, Candida albicans, Candida parapsilosis, Candida orthopsilosis, Candida metapsilosis, Grosmannia clavigera* and *Scheffersomyces stipitis*.

In some embodiments, the alcohol dehydrogenase has at least 70% sequence identity, at least 80% sequence identity, or at least 90% sequence identity with an alcohol dehydrogenase from *Clostridium* sp. In other embodiments, the alcohol dehydrogenase is an alcohol dehydrogenase selected from *Clostridium beijerinckii* adh and *Clostridium carboxidivorans* adh. In a further embodiment, the alcohol dehydrogenase comprises an amino acid sequence selected from the group consisting of SEQ ID NOs: 138 and 140. In yet another embodiment, the alcohol dehydrogenase is encoded by a nucleic acid sequence selected from the group consisting of SEQ ID NOs: 136, 137, and 139.

Dehydratase (EC 4.2.1.-)

The present disclosure describes enzymes that can catalyze the following reactions:

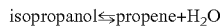

isopropanol⇌propene+H₂O

D-Xylose Isomerase (EC 5.3.1.5)

The present disclosure describes enzymes that can catalyze the following reversible reaction:

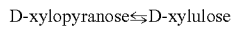

D-xylopyranose⇌D-xylulose

D-xylose isomerase may also be known as xylose isomerase or D-xylose ketol-isomerase.

Thus, in some embodiments, the disclosure provides for an enzyme that plays a role in xylose degradation.

Xylose isomerase catalyzes the first reaction in the catabolism of D-xylose.

Two conserved histidine residues, H101 and H271, were shown to be essential for catalytic activity. The fluorescence of two conserved tryptophan residues, W49 and W188, is quenched during binding of xylose, and W49 was shown to be essential for catalytic activity. The presence of $Mg^{2+}$, $Mn^{2+}$ or $Co^{2+}$ protects the enzyme from thermal denaturation.

The subunit composition has not been established experimentally.

In particular embodiments, the enzyme converts D-xylose to D-xylulose. In one embodiment, the recombinant microorganism further comprises an endogenous or exogenous xylose isomerase that catalyzes the conversion of D-xylose to D-xylulose. In one embodiment, the xylose isomerase is exogenous. In another embodiment, the xylose isomerase is encoded by one or more nucleic acid molecules obtained from *Pyromyces* sp or *E. coli*. In another embodiment, the one or more nucleic acid molecules encoding the xylose isomerase is xylA, or homolog thereof. In yet another embodiment, the one or more nucleic acid molecules encoding the xylose isomerase comprises an amino acid sequence selected from SEQ ID NOs: 95 and 144. In a further embodiment, the one or more nucleic acid molecules encoding the xylose isomerase is encoded by a nucleic acid sequence selected from the group consisting of SEQ ID NOs: 93, 94 and 143.

In some embodiments, a recombinant microorganism producing MEG or GA, or optionally, MEG or GA and one or more co-product, comprises a deletion, insertion, or loss of function mutation in a gene encoding a D-xylose isomerase to prevent conversion of D-xylose to D-xylulose and instead shunt the reaction toward the conversion of D-xylose to D-xylonate.

D-Xylulose 5-Kinase/Xylulokinase

The present disclosure describes enzymes that can catalyze the following reactions:

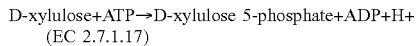

D-xylulose+ATP→D-xylulose 5-phosphate+ADP+H+
(EC 2.7.1.17)

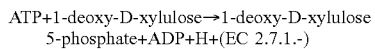

ATP+1-deoxy-D-xylulose→1-deoxy-D-xylulose
5-phosphate+ADP+H+(EC 2.7.1.-)

D-xylulose 5-kinase may also be known as xylulose kinase or xylulokinase.

Xylulokinase catalyzes the phosphorylation of D-xylulose, the second step in the xylose degradation pathway, producing D-xylulose-5-phosphate, an intermediate of the pentose phosphate pathway.

In the absence of substrate, xylulokinase has weak ATPase activity. Xylulokinase can also catalyze the phosphorylation of 1-deoxy-D-xylulose. This would allow a potential salvage pathway for generating 1-deoxy-D-xylulose 5-phosphate for use in the biosynthesis of terpenoids, thiamine and pyridoxal. The rate of phosphorylation of 1-deoxy-D-xylulose is 32-fold lower than the rate of phosphorylation of D-xylulose.

The kinetic mechanism of the bacterial enzyme has been studied, suggesting a predominantly ordered reaction mechanism. The enzyme undergoes significant conformational changes upon binding of the substrate and of ATP. Two conserved aspartate residues, D6 and D233, were found to be essential for catalytic activity, and a catalytic mechanism has been proposed.

Crystal structures of bacterial xylulokinase in the apo form and bound to D-xylulose have been determined at 2.7 and 2.1 Å resolution, respectively.

In particular embodiments, the enzyme converts D-xylulose to D-xylulose-5-phosphate. In some embodiments, the D-xylulose 5-kinase is from *Escherichia coli*. In some embodiments, the D-xylulose 5-kinase is encoded by the xylB gene. In some embodiments, the D-xylulose 5-kinase is from *Saccharomyces cerevisiae*. In some embodiments the D-xylulose 5-kinase is encoded by the XKS1 gene. In some embodiments, the D-xylulose 5-kinase is from *Pichia stipitis*. In some embodiments the D-xylulose 5-kinase is encoded by the XYL3 gene.

In some embodiments, the D-xylulose 5-kinase is encoded by an amino acid sequence having at least 70% sequence identity to xylB from *E. coli*. In a further embodiment, the D-xylulose 5-kinase is encoded by an amino acid sequence having at least 80% sequence identity to xylB from *E. coli*. In yet a further embodiment, the D-xylulose 5-kinase is encoded by an amino acid sequence having at least 90% sequence identity to xylB from *E. coli*. In other embodiments, the D-xylulose 5-kinase is xylB from *E. coli*.

In one embodiment, the D-xylulose 5-kinase is encoded by one or more nucleic acid molecules obtained from *E. coli*. In some embodiments, the one or more nucleic acid molecules encoding the D-xylulose 5-kinase is xylB, or homolog thereof. In another embodiment, the one or more nucleic acid molecules encoding the D-xylulose 5-kinase comprises an amino acid sequence set forth in SEQ ID NO: 146. In a further embodiment, the one or more nucleic acid molecules encoding the D-xylulose 5-kinase is encoded by a nucleic acid sequence set forth in SEQ ID NO: 145.

In some embodiments, a ribulokinase enzyme catalyzes the phosphorylation of D-ribulose to D-ribulose-5-phosphate. In some embodiments, the ribulokinase enzyme is encoded by *E. coli* AraB. In some embodiments, the ribulokinase enzyme is encoded by a nucleic acid sequence having at least 70% sequence identity, at least 80% sequence identity, or at least 90% sequence identity to AraB from *E. coli* (SEQ ID NO: 288).

In some embodiments, a ribokinase enzyme catalyzes the phosphorylation of D-ribose to D-ribose-5-phosphate. In some embodiments, the ribokinase enzyme is encoded by *E. coli* rbsK. In some embodiments, the ribulokinase enzyme is encoded by a nucleic acid sequence having at least 70% sequence identity, at least 80% sequence identity, or at least 90% sequence identity to rbsK from *E. coli* (SEQ ID NO: 290).

In some embodiments, a xylulokinase enzyme catalyzes the phosphorylation of D-xylulose to D-xylulose-5-phosphate. In some embodiments, the ribokinase enzyme is encoded by *T. maritima* XuK. In some embodiments, the ribulokinase enzyme is encoded by a nucleic acid sequence having at least 70% sequence identity, at least 80% sequence identity, or at least 90% sequence identity to XuK from *T. maritima* (SEQ ID NO: 291).

Glycolaldehyde Dehydrogenase (1.2.1.21)

The present disclosure describes enzymes that can catalyze the following reaction:

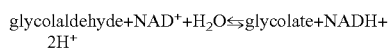

This enzyme belongs to the family of oxidoreductases, specifically those acting on the aldehyde or oxo group of donor with NAD+ or NADP+ as acceptor. This enzyme participates in glyoxylate and dicarboxylate metabolism.

Glycolaldehyde dehydrogenase may also be known as glycolaldehyde:NAD+ oxidoreductase or glycol aldehyde dehydrogenase.

In *E. coli* aldehyde dehydrogenase A (AldA) is an enzyme of relatively broad substrate specificity for small α-hydroxy-aldehyde substrates. It is thus utilized in several metabolic pathways.

L-fucose and L-rhamnose are metabolized through parallel pathways which converge after their corresponding aldolase reactions yielding the same products: dihydroxyacetone phosphate and L-lactaldehyde. Aerobically, aldehyde dehydrogenase A oxidizes L-lactaldehyde to L-lactate.

In parallel pathways utilizing the same enzymes, D-arabinose and L-xylose can be metabolized to dihydroxyacetone phosphate and glycolaldehyde, which is oxidized to glycolate by aldehyde dehydrogenase A.

Crystal structures of the enzyme alone and in ternary and binary complexes have been solved.

Aldehyde dehydrogenase A is only present under aerobic conditions and is most highly induced by the presence of fucose, rhamnose or glutamate. The enzyme is inhibited by NADH, which may act as a switch to shift from oxidation of lactaldehyde to its reduction by propanediol oxidoreductase. AldA is upregulated during short-term adaptation to glucose limitation.

Based on sequence similarity, AldA was predicted to be a succinate-semialdehyde dehydrogenase.

Regulation of aldA expression has been investigated. The gene is regulated by catabolite repression, repression under anaerobic conditions via ArcA, and induction by the carbon source.

In particular embodiments, the enzyme converts glycolaldehyde to glycolate. In some embodiments, the glycolaldehyde dehydrogenase is from *Escherichia coli*. In some embodiments, the glycolaldehyde dehydrogenase is encoded by the aldA gene.

In some embodiments, a recombinant microorganism producing MEG or glycolic acid, or MEG and one or more co-product, comprises a deletion, insertion, or loss of function mutation in a gene encoding a glycolaldehyde dehydrogenase to prevent the production of glycolic acid from glycolaldehyde and instead shunt the reaction toward conversion of glycolaldehyde to MEG. In some embodiments, the deletion, disruption, mutation, and/or reduction in the activity of a glycolaldehyde dehydrogenase that catalyzes the conversion of glycolaldehyde to glycolic acid is partial, wherein an amount of glycolic acid is still produced.

In other embodiments, a recombinant microorganism producing glycolic acid comprises or expresses at least one nucleic acid molecule encoding a glycolaldehyde dehydrogenase.

Lactate Dehydrogenase (1.1.1.28)

The present disclosure describes enzymes that can catalyze the following reaction:

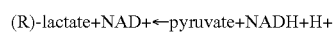

Lactate dehydrogenase (LDH) is an enzyme found in nearly all living cells such as in animals, plants and prokaryotes. LDH catalyzes the conversion of lactate to pyruvic acid and back, as it converts NADH to NAD+ and back. A dehydrogenase is an enzyme that transfers a hydride from one molecule to another.

LDH exist in four distinct enzyme classes. The most common one is NAD(P)-dependent L-lactate dehydrogenase. Other LDHs act on D-lactate and/or are dependent on cytochrome c: D-lactate dehydrogenase (cytochrome) and L-lactate dehydrogenase (cytochrome).

LDH has been of medical significance because it is found extensively in body tissues, such as blood cells and heart muscle. Because it is released during tissue damage, it is a marker of common injuries and disease such as heart failure.

Lactate dehydrogenase may also be known as lactic acid dehydrogenase, (R)-lactate: NAD+ oxidoreductase or D-lactate dehydrogenase-fermentative.

In *E. coli*, lactate dehydrogenase (LdhA) is a soluble NAD-linked lactate dehydrogenase (LDH) that is specific for the production of D-lactate. LdhA is a homotetramer and shows positive homotropic cooperativity under higher pH conditions.

*E. coli* contains two other lactate dehydrogenases: D-lactate dehydrogenase and L-lactate dehydrogenase. Both are membrane-associated flavoproteins required for aerobic growth on lactate.

LdhA is present under aerobic conditions but is induced when *E. coli* is grown on a variety of sugars under anaerobic conditions at acidic pH. Unlike most of the genes involved in anaerobic respiration, ldhA is not activated by Fnr; rather the ArcAB system and several genes involved in the control of carbohydrate metabolism (csrAB and mlc) appear to regulate expression. The expression of IdhA is negatively affected by the transcriptional regulator ArcA. IdhA belongs to the σ32 regulon.

The IdhA gene is a frequent target for mutations in metabolic engineering, most often to eliminate production of undesirable fermentation side products, but also to specifically produce D-lactate.

In particular embodiments, the enzyme converts pyruvate to lactate. In some embodiments, the lactate dehydrogenase is from *Escherichia coli*. In some embodiments, the lactate dehydrogenase is encoded by the IdhA gene.

In some embodiments, a recombinant microorganism producing MEG or GA, or MEG and one or more co-product, comprises a deletion, insertion, or loss of function mutation in a gene encoding a lactate dehydrogenase to prevent the production of lactate from pyruvate and instead shunt the reaction toward production of one or more co-products.

Soluble Pyridine Nucleotide Transhydrogenase (EC 1.6.1.1.)

The present disclosure describes enzymes that can catalyze the following reaction:

NADH+NADP+⇌NAD++NADPH

Soluble pyridine nucleotide transhydrogenase may also be known as NAD(P)+ transhydrogenase (B-specific), STH, pyridine nucleotide transhydrogenase, or transhydrogenase.

*E. coli* contains both a soluble and a membrane-bound pyridine nucleotide transhydrogenase. The soluble pyridine nucleotide transhydrogenase is the sthA or udhA gene product; its primary physiological role appears to be the reoxidation of NADPH. The membrane-bound proton-translocating transhydrogenase is the pntAB gene product; PntAB is a major source of NADPH.

UdhA contains noncovalently bound FAD and is present in a form consisting of seven or eight monomers. Moderate overexpression of UdhA (SthA) allows an increased maximal growth rate of a phosphoglucose isomerase mutant, and a pgi sthA double mutant is not viable. These phenotypes may be due to the ability of UdhA to restore the cellular redox balance under conditions of excess NADPH formation. Mutations in sthA appear during adaptation of a pgi mutant strain to growth on glucose minimal medium. Transcription of sthA is downregulated by growth on glycerol.

In some embodiments, expression of a transhydrogenase can increase activity of a NADPH-dependent alcohol dehydrogenase, leading to improved acetone to 2-propanol conversion. In one embodiment, the soluble pyridine nucleotide transhydrogenase is encoded by one or more nucleic acid molecules obtained from *E. coli*. In another embodiment, the one or more nucleic acid molecules encoding the soluble pyridine nucleotide transhydrogenase is udhA, or homolog thereof. In some embodiments, the one or more nucleic acid molecules encoding the soluble pyridine nucleotide transhydrogenase comprises an amino acid sequence set forth in SEQ ID NO: 142. In some embodiments, the one or more nucleic acid molecules encoding the soluble pyridine nucleotide transhydrogenase is encoded by a nucleic acid sequence set forth in SEQ ID NO: 141.

Hydroxymethylglutaryl-CoA Synthase (EC 2.3.3.-)

The present disclosure describes enzymes that can catalyze the following reaction:

acetoacetyl-CoA+acetyl-CoA+H$_2$O↔(S)-3-hydroxy-3-methylglutaryl-CoA+coenzyme A+H$^+$ Hydroxymethylglutaryl-CoA synthase may also be known as (S)-3-hydroxy-3-methylglutaryl-CoA acetoacetyl-CoA-lyase (CoA-acetylating), 3-hydroxy-3-methylglutaryl CoA synthetase, 3-hydroxy-3-methylglutaryl coenzyme A synthase, 3-hydroxy-3-methylglutaryl coenzyme A synthetase, 3-hydroxy-3-methylglutaryl-CoA synthase, 3-hydroxy-3-methylglutaryl-coenzyme A synthase, β-hydroxy-β-methylglutaryl-CoA synthase, HMG-CoA synthase, acetoacetyl coenzyme A transacetase, hydroxymethylglutaryl coenzyme A synthase, and hydroxymethylglutaryl coenzyme A-condensing enzyme.

Hydroxymethylglutaryl-CoA synthase catalyzes the condensation of acetyl-CoA with acetoacetyl-CoA to form (S)-3-hydroxy-3-methylglutaryl-CoA, an early stage in the synthesis of (R)-mevalonate, a precursor of cholesterol.

The enzyme catalyzes a complex reaction that can be divided into four steps. The first step involves the formation of an enzyme acetyl-CoA binary complex, followed by the transfer of the acetyl group from the CoA thioester to a cysteine residue on the enzyme, forming a thioester acyl-enzyme intermediate. In the next step the now reduced CoA dissociates, and the second substrate, acetoacetyl-CoA, binds the enzyme. The third step involves the formation of a carbanion by removal of a proton from the methyl of the acetylcysteine. The activated acetylcysteine then undergoes a Claisen-like condensation with the γ-carbon of the acetoacetyl-CoA ligand, which forms the HMG-CoA while retaining the thioester bond to the enzyme. The last step comprises the hydrolysis of this bond, resulting in free HMG-CoA.

The HMGCS1 gene from *Homo sapiens* has been cloned and sequenced (Russ A P et al. (1992) Amplification and direct sequencing of a cDNA encoding human cytosolic 3-hydroxy-3-methylglutaryl-coenzyme A synthase. Biochim Biophys Acta 1132(3): 329-31). The gene was expressed in *Escherichia coli*, and the recombinant protein was purified and characterized (Rokosz L L et al. (1994) Human cytoplasmic 3-hydroxy-3-methylglutaryl coenzyme A synthase: expression, purification, and characterization of recombinant wild-type and Cys129 mutant enzymes. Arch Biochem Biophys 312(1): 1-13). The enzyme is a homodimer of 120 kDa. Catalysis proceeds by formation of a covalent acetyl-enzyme intermediate. Kinetic data suggest that the two substrates (acetyl-CoA and acetoacetyl-CoA) compete for binding to the same site.

In one embodiment, the hydroxymethylglutaryl-CoA synthase can have a 3-hydroxyisovalerate (3HIV) synthase activity and can catalyze the following reaction:

acetone+acetyl-CoA+H$_2$O↔3-hydroxyisovalerate

In one embodiment, the 3HIV synthase is encoded by one or more nucleic acid molecules obtained from a microorganism selected from *Mus* sp., *Saccharomyces* sp., *Lactobacillus* sp. and *Polaromonas* sp. In another embodiment, the 3HIV synthase is encoded by one or more nucleic acid molecules obtained from a microorganism selected from *Mus musculus, Saccharomyces cerevisiae, Lactobacillus crispatus* and *Polaromonas naphthalenivorans*. In some embodiments, the one or more nucleic acid molecules encoding the 3HIV synthase is selected from Hmgcs1, ERG13, PksG and/or Pnap_0477, or homolog thereof. In a further embodiment, the one or more nucleic acid molecules encoding the 3HIV synthase comprises an amino acid sequence selected from the group consisting of SEQ ID NOs: 105, 107, 109 and 111. In yet another embodiment, the one or more nucleic acid molecules encoding the 3HIV synthase is encoded by a nucleic acid sequence selected from the group consisting of SEQ ID NOs: 104, 106, 108 and 110. In some embodiments, the one or more nucleic acid molecules encoding the hydroxymethylglutaryl-CoA synthase is hmgS, or homolog thereof. In a further embodiment, the one or more nucleic acid molecules encoding the hydroxymethylglutaryl-CoA synthase comprises an amino acid sequence set forth in SEQ ID NO: 123. In yet another embodiment, the one or more nucleic acid molecules encoding the hydroxymethylglutaryl-CoA synthase is encoded by a nucleic acid sequence set forth in SEQ ID NO: 122.

Methylglutaconyl-CoA Hydratase (EC 4.2.1.18)

The present disclosure describes enzymes that can catalyze the following reaction:

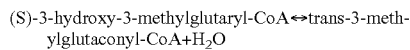
(S)-3-hydroxy-3-methylglutaryl-CoA↔trans-3-methylglutaconyl-CoA+H$_2$O This enzyme catalyzes the syn-hydration of 3-methylglutaconyl-CoA to (S)-3-hydroxy-3-methylglutaryl-CoA in the leucine degradation pathway. The bacterial enzyme has been characterized in *Pseudomonas putida*. It differs from the mammalian enzyme in having only one glutamyl residue in its active site rather than two, resulting in a different reaction mechanism. These enzymes are members of the crotonase superfamily (Wong B J and Gerlt J A (2004) Evolution of function in the crotonase superfamily: (3S)-methylglutaconyl-CoA hydratase from *Pseudomonas putida*. Biochemistry 43(16): 4646-4654) and reviewed in (Hamed R B et al. (2008) Mechanisms and structures of crotonase superfamily enzymes—how nature controls enolate and oxyanion reactivity. Cell Mol Life Sci 65(16): 2507-2527).

Recombinant enzyme was expressed in *Escherichia coli*, purified and characterized. The apparent molecular mass of the 10-His-tagged polypeptide was determined to be 32.251 kDa by ESI-MS. The 10-His-tag was subsequently removed before characterization of the enzyme (Wong and Gerlt 2004).

In one embodiment, the methylglutaconyl-CoA hydratase is encoded by one or more nucleic acid molecules obtained from *Pseudomonas* sp. In another embodiment, the methylglutaconyl-CoA hydratase is encoded by one or more nucleic acid molecules obtained from *Pseudomonas putida*. In some embodiments, the one or more nucleic acid molecules encoding the methylglutaconyl-CoA hydratase is liuC, or homolog thereof. In a further embodiment, the one or more nucleic acid molecules encoding the methylglutaconyl-CoA hydratase comprises an amino acid sequence set forth in SEQ ID NO: 125. In yet another embodiment, the one or more nucleic acid molecules encoding the methylglutaconyl-CoA hydratase is encoded by a nucleic acid sequence set forth in SEQ ID NO: 124.

Methylcrotonyl-CoA Carboxylase (EC 6.4.1.4)

The present disclosure describes enzymes that can catalyze the following reaction:

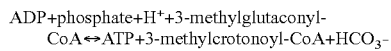
ADP+phosphate+H$^+$+3-methylglutaconyl-CoA↔ATP+3-methylcrotonoyl-CoA+HCO$_3^-$ The enzyme activity is associated with the 3-methylcrotonyl-CoA carboxylase complex. This enzyme is a biotin-containing, biotin-dependent carboxylase involved in the L-leucine (and isovalerate) degradation pathway of *Pseudomonas aeruginosa* PAO1. This pathway is also the last phase of the acyclic terpene utilization pathway (citronellol degradation and cis-genanyl-CoA degradation pathways). The enzyme is not expressed in citronellol or citronellate grown cells, but is expressed in isovalerate grown cells. Genes liuB and liuD encode the two subunits of 3-methylcrotonyl-CoA carboxylase. The subunits are encoded in the liuRABCDE gene cluster of this organism (Hoschle B et al. (2005) Methylcrotonyl-CoA and geranyl-CoA carboxylases are involved in leucine/isovalerate utilization (Liu) and acyclic terpene utilization (Atu), and are encoded by liuB/liuD and atuC/atuF, in *Pseudomonas aeruginosa*. Microbiology 151(Pt 11): 3649-3656; Forster-Fromme K and Jendrossek D (2010). Catabolism of citronellol and related acyclic terpenoids in pseudomonads. Appl Microbiol Biotechnol 87(3): 859-869).

The enzyme was purified from cell extracts by avidin-affinity chromatography and the SDS-gel-isolated subunits were subjected to trypsin fingerprint analysis and ESI-MS which allowed identification of their corresponding genes (Hoschle et al. 2005).

The 3-methylcrotonyl-CoA carboxylase of *Pseudomonas citronellolis* was characterized in earlier work (Hector M L and Fall R R (1976) Multiple acyl-coenzyme A carboxylases in *Pseudomonas citronellolis*. Biochemistry 15(16): 3465-3472; Fall R R and Hector M L (1977) Acyl-coenzyme A carboxylases. Homologous 3-methylcrotonyl-CoA and geranyl-CoA carboxylases from *Pseudomonas citronellolis*. Biochemistry 16(18): 4000-4005; Fall R R (1981) 3-Methylcrotonyl-CoA and geranyl-CoA carboxylases from *Pseudomonas citronellolis*. Methods Enzymol 71 Pt C: 791-799).

In one embodiment, the methylcrotonyl-CoA carboxylase is encoded by one or more nucleic acid molecules obtained from *Pseudomonas* sp. In another embodiment, the methylcrotonyl-CoA carboxylase is encoded by one or more nucleic acid molecules obtained from *Pseudomonas aeruginosa*. In some embodiments, the one or more nucleic acid molecules encoding the methylcrotonyl-CoA carboxylase is selected from liuB and/or liuD, or homologs thereof. In a further embodiment, the one or more nucleic acid molecules encoding the methylcrotonyl-CoA carboxylase comprises an amino acid sequence selected from SEQ ID NOs: 127 and 129. In yet another embodiment, the one or more nucleic acid molecules encoding the methylcrotonyl-CoA carboxylase is encoded by a nucleic acid sequence selected from SEQ ID NOs: 126 and 128.

Methylcrotonyl-CoA Hydratase (EC 4.2.1.17)

The present disclosure describes enzymes that can catalyze the following reaction:

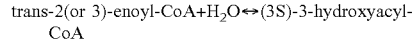
trans-2(or 3)-enoyl-CoA+H$_2$O↔(3S)-3-hydroxyacyl-CoA

An exemplary enzyme is a 3-ketoacyl-CoA thiolase. It is involved in the degradation of fatty acids via the β-oxidation cycle. It has broad chain-length specificity for substrates although it exhibits its highest activity with medium-chain substrates. It is part of a multienzyme complex and is coded for by the fadA gene (Yang S Y et al (1990) Nucleotide sequence of the fadA gene. Primary structure of 3-ketoacyl-coenzyme A thiolase from *Escherichia coli* and the structural organization of the fadAB operon. J Biol Chem 265 (18): 10424-10429; Binstock J F and Schulz H (1981) Fatty acid oxidation complex from *Escherichia coli*. Methods Enzymol 71 Pt C:403-11).

3-ketoacyl-CoA thiolase may also be known as acetyl-CoA C-acyltransferase, β-ketothiolase, acetyl-CoA acyltransferase and acyl-CoA:acetyl-CoA C-acyltransferase.

Another exemplary enzyme is an enoyl-CoA hydratase. The alpha subunit has four enzymatic activities associated with it. It is part of a multienzyme complex. Two of the activities, enoyl-CoA hydratase (EC 4.2.1.17) and 3-OH acyl-CoA epimerase (EC 5.1.2.3) are carried out by the same N terminal active site (Yang S Y and Elzinga M (1993) Association of both enoyl coenzyme A hydratase and 3-hydroxyacyl coenzyme A epimerase with an active site in the amino-terminal domain of the multifunctional fatty acid oxidation protein from *Escherichia coli*. J Biol Chem 268 (9): 6588-6592).

In one embodiment, the methylcrotonyl-CoA hydratase is a 3-ketoacyl-CoA thiolase. In another embodiment, the methylcrotonyl-CoA hydratase is encoded by one or more nucleic acid molecules obtained from *Escherichia coli*. In some embodiments, the one or more nucleic acid molecules encoding the methylcrotonyl-CoA hydratase is fadA, or homolog thereof. In a further embodiment, the one or more nucleic acid molecules encoding the methylcrotonyl-CoA hydratase comprises an amino acid sequence set forth in SEQ ID NO: 131. In yet another embodiment, the one or more nucleic acid molecules encoding the methylcrotonyl-CoA hydratase is encoded by a nucleic acid sequence set forth in SEQ ID NO: 130.

In one embodiment, the methylcrotonyl-CoA hydratase is an enoyl-CoA hydratase. In another embodiment, the methylcrotonyl-CoA hydratase is encoded by one or more nucleic acid molecules obtained from *Escherichia coli*. In some embodiments, the one or more nucleic acid molecules encoding the methylcrotonyl-CoA hydratase is fadB, or homolog thereof. In a further embodiment, the one or more nucleic acid molecules encoding the methylcrotonyl-CoA hydratase comprises an amino acid sequence set forth in SEQ ID NO: 133. In yet another embodiment, the one or more nucleic acid molecules encoding the methylcrotonyl-CoA hydratase is encoded by a nucleic acid sequence set forth in SEQ ID NO: 132.

3-Hydroxy-Isovaleryl-CoA Thioesterase (EC 3.1.2.-)

The present disclosure describes enzymes that can catalyze the following reactions:

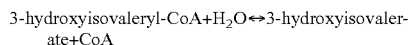

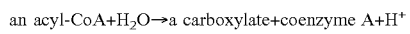

An exemplary acyl-CoA thioesterase is TesB. Thioesterase II (TesB) is one of a number of thioesterases present in *E. coli*. The enzyme has relatively broad substrate specificity, cleaving medium- and long-chain acyl-CoA substrates; the best tested substrate was 3,5-tetradecadienoyl-CoA (Nie L et al. (2008) A novel paradigm of fatty acid beta-oxidation exemplified by the thioesterase-dependent partial degradation of conjugated linoleic acid that fully supports growth of *Escherichia coli*. Biochemistry 47(36): 9618-9626). Thioesterase II is one of the thioesterases supporting growth on oleate or conjugated linoleic acid as the sole source of carbon (Nie et al. 2008).

A crystal structure of the enzyme has been solved at 1.9 Å resolution. The D204 residue was predicted to be in the active site; its importance was confirmed by kinetic analysis of mutants (Li J et al. (2000) Crystal structure of the *Escherichia coli* thioesterase II, a homolog of the human Nef binding enzyme. Nat Struct Biol 7(7): 555-559).

Strains either lacking or overproducing tesB have no obvious defect (Narasimhan M L et al. (1986) Genetic and biochemical characterization of an *Escherichia coli* K-12 mutant deficient in acyl-coenzyme A thioesterase II. J Bacteriol 165(3): 911-917; Naggert J et al. (1991) Cloning, sequencing, and characterization of *Escherichia coli* thioesterase II. J Biol Chem 266(17): 11044-11050). Overproduction of TesB relieves inhibition of fatty acid synthesis by long-chain acyl-ACP molecules that accumulate upon glycerol starvation (Jiang P and Cronan J E (1994) Inhibition of fatty acid synthesis in *Escherichia coli* in the absence of phospholipid synthesis and release of inhibition by thioesterase action. J Bacteriol 176(10): 2814-2821).

In one embodiment, the 3-hydroxy-isovaleryl-CoA thioesterase is encoded by one or more nucleic acid molecules obtained from *E. coli*. In some embodiments, the one or more nucleic acid molecules encoding the 3-hydroxy-isovaleryl-CoA thioesterase is tesB, or homolog thereof. In a further embodiment, the one or more nucleic acid molecules encoding the 3-hydroxy-isovaleryl-CoA thioesterase comprises an amino acid sequence set forth in SEQ ID NO: 135. In yet another embodiment, the one or more nucleic acid molecules encoding the 3-hydroxy-isovaleryl-CoA thioesterase is encoded by a nucleic acid sequence set forth in SEQ ID NO: 134.

Mevalonate-3-Kinase (EC 2.7.1.-)

The present disclosure describes enzymes that can catalyze the following reaction:

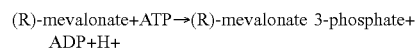

Mevalonate-3-kinase may also be known as (R)-MVA 3-phosphotransferase or 3-hydroxyisovalerate (3HIV) kinase.

The subunit structure of this enzyme from *Thermoplasma acidophilum* has not been reported.

The mevalonate-3-kinase from the thermophilic archaeon *Thermoplasma acidophilum* is thought to participate in a variant of the mevalonate pathway found in archaea Azami Y et al. (2014) (R)-Mevalonate 3-Phosphate Is an Intermediate of the Mevalonate Pathway in *Thermoplasma acidophilum*. J Biol Chem 289(23): 15957-15967; Vinokur J M et al. (2014) Evidence of a Novel Mevalonate Pathway in Archaea. Biochemistry 53(25): 4161-4168).

Recombinant His-tagged enzyme was expressed in *Escherichia coli*, purified and characterized. Despite its homology with diphosphomevalonate decarboxylase, it showed no decarboxylase activity (Azami et al. 2014; Vinokur et al. 2014). The enzyme showed weak phosphomevalonate kinase activity, producing small amounts of (R)-mevalonate diphosphate (Azami et al. 2014). It had no mevalonate-5-kinase activity (Vinokur et al. 2014).

In one embodiment, the 3HIV kinase is encoded by one or more nucleic acid molecules obtained from a microorganism selected from the group consisting of *Thermoplasma* sp. and *Picrophilus* sp. In another embodiment, the 3HIV kinase is encoded by one or more nucleic acid molecules obtained from a microorganism selected from the group consisting of *Thermoplasma acidophilum* and *Picrophilus torridus*. In some embodiments, the one or more nucleic acid molecules encoding the 3HIV kinase is TA1305 and/or PTO1356, or homolog thereof. In some embodiments, the TA1305 comprises a L200E mutation. In a further embodiment, the one or more nucleic acid molecules encoding the 3HIV-kinase comprises an amino acid sequence selected from the group consisting of SEQ ID NOs: 113, 115 and 117. In yet another embodiment, the one or more nucleic acid molecules encoding the 3HIV kinase is encoded by a nucleic acid sequence selected from the group consisting of SEQ ID NOs: 112, 114 and 116.

Mevalonate Diphosphate Decarboxylase (EC 4.1.1.-)

The present disclosure describes enzymes that can catalyze the following reactions:

(R)-mevalonate diphosphate+ATP→isopentenyl diphosphate+$CO_2$+ADP+phosphate 3-phosphonoxyisovalerate→$CO_2$+isobutene 3-hydroxyisovalerate→$CO_2$+isobutene Mevalonate diphosphate decarboxylase may also be known as pyrophosphomevalonate decarboxylase, mevalonate-5-pyrophosphate decarboxylase, pyrophosphomevalonic acid decarboxylase, 5-pyrophosphomevalonate decarboxylase, mevalonate 5-diphosphate decarboxylase, and ATP:(R)-5-diphosphomevalonate carboxy-lyase (dehydrating), 3-phosphonoxyisovalerate decarboxylase, 3-hydroxyisovalerate-3-phosphate decarboxylase, 3HIV-3-phosphate decarboxylase, 3-hydroxyisovalerate decarboxylase and 3HIV decarboxylase.

This enzyme converts mevalonate 5-diphosphate (MVAPP) to isopentenyl diphosphate (IPP) through ATP dependent decarboxylation. The two substrates of this enzyme are ATP and mevalonate 5-diphosphate, whereas its four products are ADP, phosphate, isopentenyl diphosphate, and $CO_2$.

Mevalonate diphosphate decarboxylase catalyzes the final step in the mevalonate pathway. The mevalonate pathway is responsible for the biosynthesis of isoprenoids from acetate. This pathway plays a key role in multiple cellular processes by synthesizing sterol isoprenoids, such as cholesterol, and non-sterol isoprenoids, such as dolichol, heme A, tRNA isopentenyltransferase, and ubiquinone. This enzyme belongs to the family of lyases, specifically the carboxylyases, which cleave carbon-carbon bonds.

Mevalonate diphosphate decarboxylase recognizes and binds two substrates: ATP and mevalonate 5-diphosphate. After binding, the enzyme performs three types of reactions that can be separated into two main stages. First, phosphorylation occurs. This creates a reactive intermediate, which in the second stage undergoes concerted dephosphorylation and decarboxylation.

In one embodiment, the enzyme that catalyzes the reaction 3-phosphonoxyisovalerate→$CO_2$+isobutene is a 3HIV-3-phosphate decarboxylase. In another embodiment, the 3HIV-3-phosphate decarboxylase is encoded by one or more nucleic acid molecules obtained from *Streptococcus* sp. In some embodiments, the microorganism is selected from *Streptococcus mitis* and/or *Streptococcus gordonii*. In some embodiments, the one or more nucleic acid molecules encoding the 3HIV-3-phosphate decarboxylase comprises an amino acid sequence selected from SEQ ID NOs: 119 and 121. In further embodiments, the one or more nucleic acid molecule encoding the 3HIV-3-phosphate decarboxylase is encoded by a nucleic acid sequence selected from SEQ ID NOs: 118 and 120.

In one embodiment, the enzyme that catalyzes the reaction 3-hydroxyisovalerate→$CO_2$+isobutene is a 3HIVdecarboxylase. In another embodiment, the 3HIV decarboxylase is encoded by one or more nucleic acid molecules obtained from a microorganism selected from the group consisting of *Streptococcus* sp., *Thermoplasma* sp. and *Picrophilus* sp. In another embodiment, the 3HIV decarboxylase is encoded by one or more nucleic acid molecules obtained from a microorganism selected from the group consisting of *Streptococcus gordonii*, *Thermoplasma acidophilum* and *Picrophilus torridus*. In some embodiments, the one or more nucleic acid molecules encoding the 3HIV decarboxylase comprises mvaD, TA1305 and/or PTO1356, or homolog thereof. In a further embodiment, the one or more nucleic acid molecules encoding the 3HIV decarboxylase comprises an amino acid sequence selected from the group consisting of SEQ ID NOs: 113, 117 and 121. In yet another embodiment, the one or more nucleic acid molecules encoding the 3HIV decarboxylase is encoded by a nucleic acid sequence selected from the group consisting of SEQ ID NOs: 112, 116 and 120.

Transketolase (EC 2.2.1.1)

The present disclosure describes enzymes that can catalyze the following reactions:

D-erythrose 4-phosphate+D-xylulose 5-phosphate↔β-D-fructofuranose 6-phosphate+D-glyceraldehyde 3-phosphate D-sedoheptulose 7-phosphate+D-glyceraldehyde 3-phosphate↔D-ribose 5-phosphate+D-xylulose 5-phosphate Transketolase may also be known as glycolaldehydetransferase.

Transketolase catalyzes the reversible transfer of a ketol group between several donor and acceptor substrates. This key enzyme is a reversible link between glycolysis and the pentose phosphate pathway. The enzyme is involved in the catabolism of pentose sugars, the formation of D-ribose 5-phosphate, and the provision of D-erythrose 4-phosphate, a precursor of aromatic amino acids and PLP. *E. coli* contains two transketolase isozymes, TktA and TktB. TktA is responsible for the major transketolase activity.

In addition to its function in central carbon metabolism, transketolase appears to also have an unexpected role in chromosome structure; a tktA mutant affects chromosome topology.

Crystal structures of TktA in complex with donor and acceptor substrates have been solved, elucidating the reaction mechanism and mode of action of transketolase. A computational model of transketolase activity using a quantum mechanical/molecular mechanical method has been proposed, defining a new route for thiamine diphosphate activation. Transketolase I (TktA) is homodimeric. The urea denaturation pathways of wild type and active site mutants of TktA have been investigated, and the effects of temperature and pH on the structure, stability, aggregation and activity of transketolase have been determined. The acceptor specificity of TktA has been investigated.

TktA abundance is affected by the SOS inducer and mutagen 7-methoxy-2-nitronaphtho[2,1-b]furan (R7000). tktA is negatively regulated during entry into stationary phase. The effect by RpoS is likely indirect and might be mediated by an intermediate regulator that itself is directly regulated by RpoS.

The subunit structure of transketolase II (TktB) has not been explicitly determined. Overproduction of TktB suppresses the tktA mutant phenotype. Expression of tktB is increased in a tyrR mutant in the presence of phenylalanine. tktB expression is increased in stationary phase and positively regulated by RpoS and ppGpp. Levels of TktB protein increase during osmotic stress under aerobic, but not anaerobic growth conditions. TktB appears to be associated with the degradosome and may connect carbon metabolism to replication.

Expression of tktA and tktB is complementary, resulting in approximately constant levels of transketolase expression throughout growth.

In some embodiments, the transketolase is encoded by an amino acid sequence having at least 70% sequence identity to tktA from *E. coli*. In a further embodiment, the transketolase is encoded by an amino acid sequence having at least 80% sequence identity to tktA from *E. coli*. In yet a further embodiment, the transketolase is encoded by an amino acid sequence having at least 90% sequence identity to tktA from *E. coli*. In other embodiments, the transketolase is tktA from *E. coli*. In some embodiments, the transketolase is encoded by an amino acid sequence having at least 70% sequence identity to tktB from *E. coli*. In a further embodiment, the transketolase is encoded by an amino acid sequence having at least 80% sequence identity to tktB from *E. coli*. In yet a further embodiment, the transketolase is encoded by an amino acid sequence having at least 90% sequence identity to tktB from *E. coli*. In other embodiments, the transketolase is tktB from *E. coli*.

In some embodiments, the one or more nucleic acid molecules encoding the transketolase is tktA, or homolog thereof. In some embodiments, the one or more nucleic acid molecules encoding the transketolase is tktB, or homolog thereof. In another embodiment, the one or more nucleic acid molecules encoding the transketolase comprises an amino acid sequence selected from the group consisting of SEQ ID NOs: 148 and 150. In a further embodiment, the one or more nucleic acid molecule encoding the transketolase is encoded by a nucleic acid sequence selected from the group consisting of SEQ ID NOs: 147 and 149.

Transaldolase (EC 2.2.1.2)

The present disclosure describes enzymes that can catalyze the following reaction:

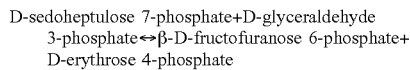

D-sedoheptulose 7-phosphate+D-glyceraldehyde 3-phosphate↔β-D-fructofuranose 6-phosphate+ D-erythrose 4-phosphate Transaldolase may also be known as dihydroxyacetonetransferase; dihydroxyacetone synthase; formaldehyde transketolase.

Transaldolase B is an enzyme of the non-oxidative branch of the pentose phosphate pathway. Along with transketolase, transaldolase creates a reversible link between the pentose phosphate pathway and glycolysis. It catalyzes the interconversion of glyceraldehyde-3-phosphate and sedoheptulose-7-phosphate to fructose-6-phosphate and erythrose-4-phosphate. The reversibility of this reaction and carbon flux through the pentose phosphate pathway has been addressed both experimentally and theoretically.

There are two closely related transaldolases in *E. coli*, encoded by talA and talB. Only transaldolase B has been biochemically characterized. TalB is a dimer in solution and in the crystal structure. Mutation of the R300 residue leads to the formation of catalytically active monomers. Catalytically important active site residues have been identified by site-directed mutagenesis.

Crystal structures of transaldolase B have been determined, confirming the presence of a Schiff-base intermediate at the active site and leading to a proposed reaction mechanism.

A talB null mutant has no growth defect on minimal media with glucose as the carbon source.

In some embodiments, the transaldolase is encoded by an amino acid sequence having at least 70% sequence identity to talA or talB from *E. coli*. In a further embodiment, the transaldolase is encoded by an amino acid sequence having at least 80% sequence identity to talA or talB from *E. coli*. In yet a further embodiment, the transaldolase is encoded by an amino acid sequence having at least 90% sequence identity to talA or talB from *E. coli*. In other embodiments, the transaldolase is talA from *E. coli*. In yet further embodiments, the transaldolase is talB from *E. coli*.

In some embodiments, the one or more nucleic acid molecules encoding the transaldolase is talA, or homolog thereof. In some embodiments, the one or more nucleic acid molecules encoding the transaldolase is talB, or homolog thereof. In another embodiment, the one or more nucleic acid molecules encoding the transaldolase comprises an amino acid sequence selected from the group consisting of SEQ ID NOs: 152 and 154. In a further embodiment, the one or more nucleic acid molecule encoding the transaldolase is encoded by a nucleic acid sequence selected from the group consisting of SEQ ID NOs: 151 and 153.

Ribose-5-Phosphate Isomerase (EC 5.3.1.6)

The present disclosure describes enzymes that can catalyze the following reaction:

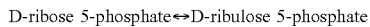

D-ribose 5-phosphate↔D-ribulose 5-phosphate

Ribose-5-phosphate isomerase may also be known as phosphopentosisomerase; phosphoriboisomerase; ribose phosphate isomerase; 5-phosphoribose isomerase; D-ribose 5-phosphate isomerase; D-ribose-5-phosphate ketol-isomerase.

There are two physically and genetically distinct ribose-5-phosphate isomerases present in *E. coli*. The constitutive ribose-5-phosphate isomerase A (rpiA) normally accounts for more than 99% of the ribose-5-phosphate isomerase activity in the cell and functions in the pentose phosphate pathway (non-oxidative branch). The inducible ribose-5-phosphate isomerase B (rpiB) can substitute for rpiA's function if its expression is induced. There is no sequence similarity between the two enzymes.

Crystal structures of RpiA have been solved and active site residues and an acid-base catalytic mechanism were predicted. An rpiA mutant requires ribose for growth.

In some embodiments, the ribose-5-phosphate isomerase is encoded by an amino acid sequence having at least 70% sequence identity to rpiA from *E. coli*. In a further embodiment, the ribose-5-phosphate isomerase is encoded by an amino acid sequence having at least 80% sequence identity to rpiA from *E. coli*. In yet a further embodiment, the ribose-5-phosphate isomerase is encoded by an amino acid sequence having at least 90% sequence identity to rpiA from *E. coli*. In other embodiments, the ribose-5-phosphate isomerase is rpiA from *E. coli*.

In some embodiments, the one or more nucleic acid molecules encoding the ribose-5-phosphate isomerase is rpiA, or homolog thereof. In another embodiment, the one or more nucleic acid molecules encoding the ribose-5-phosphate isomerase comprise an amino acid sequence set forth in SEQ ID NO: 156. In a further embodiment, the one or more nucleic acid molecule encoding the ribose-5-phosphate isomerase is encoded by a nucleic acid sequence set forth in SEQ ID NO: 155.

Ribulose-5-Phosphate 3-Epimerase (EC 5.1.3.1)

The present disclosure describes enzymes that can catalyze the following reaction:

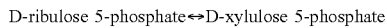

D-ribulose 5-phosphate↔D-xylulose 5-phosphate

Ribulose-5-phosphate 3-epimerase may also be known as ribulose-phosphate 3-epimerase; phosphoribulose epimerase; erythrose-4-phosphate isomerase; phosphoketopentose 3-epimerase; xylulose phosphate 3-epimerase; phosphoketopentose epimerase; D-ribulose phosphate-3-epimerase; D-ribulose 5-phosphate epimerase; D-ribulose- 5-P 3-epimerase; D-xylulose-5-phosphate 3-epimerase; pentose-5-phosphate 3-epimerase.

Ribulose-5-phosphate 3-epimerase (Rpe) is an enzyme of the non-oxidative branch of the pentose phosphate pathway.

Rpe requires ferrous iron for activity and is vulnerable to damage by $H_2O_2$ due to Fenton chemistry. $Mn^{2+}$, $Co^{2+}$ and $Zn^{2+}$ can substitute for $Fe^{2+}$ to varying degrees, and Rpe containing these alternative cations is not vulnerable to $H_2O_2$. Induction of the manganese transporter can protect Rpe from $H_2O_2$ damage.

In some embodiments, the ribulose-5-phosphate 3-epimerase is encoded by an amino acid sequence having at least 70% sequence identity to rpe from E. coli. In a further embodiment, the ribulose-5-phosphate 3-epimerase is encoded by an amino acid sequence having at least 80% sequence identity to rpe from E. coli. In yet a further embodiment, the ribulose-5-phosphate 3-epimerase is encoded by an amino acid sequence having at least 90% sequence identity to rpe from E. coli. In other embodiments, the ribulose-5-phosphate 3-epimerase is rpe from E. coli.

In some embodiments, the one or more nucleic acid molecules encoding the ribulose-5-phosphate 3-epimerase is rpe, or homolog thereof. In another embodiment, the one or more nucleic acid molecules encoding the ribulose-5-phosphate 3-epimerase comprise an amino acid sequence set forth in SEQ ID NO: 158. In a further embodiment, the one or more nucleic acid molecule encoding the ribulose-5-phosphate 3-epimerase is encoded by a nucleic acid sequence set forth in SEQ ID NO: 157.

Fructose 6-Phosphate Phosphoketolase (Fpk, EC 4.1.2.22)

The present disclosure describes enzymes that can catalyze the following reaction:

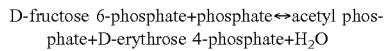

The phosphoketolase reaction by which β-D-fructofuranose 6-phosphate is converted to D-erythrose 4-phosphate and acetyl phosphate is one of the key reactions in the Bifidobacterium shunt. There is evidence for the existence of two distinct F6P-phosphoketolase enzymes in bifidobacteria. One is specific solely for F6P while the other is able to utilize both F6P and D-xylulose 5-phosphate (EC: 4.1.2.9), a reaction that appears later in the Bifidobacterium shunt. The enzyme encoded by the xfp gene, originally discovered in Bifidobacterium animalis lactis, is the dual-specificity enzyme. A phosphoketolase has also been purified from Leuconostoc nesenteroides (LEUM_1961).

In some embodiments, an enzyme having fructose-6-phosphate phosphoketolase activity is encoded by an amino acid sequence having at least 70% sequence identity, at least 80% sequence identity, or at least 90% sequence identity to an enzyme having fructose-6-phosphate phosphoketolase activity selected from the group consisting of Bifidobacterium dentium BDP_1006, Bifidobacterium lactis xfp, Lactobacillus paraplantarum xpkA and Bifidobacterium breve xfp. In a preferred embodiment, an enzyme having fructose-6-phosphate phosphoketolase activity is selected from the group consisting of Bifidobacterium dentium BDP_1006, Bifidobacterium lactis xfp, Lactobacillus paraplantarum xpkA and Bifidobacterium breve xfp. In another embodiment, the one or more nucleic acid molecules encoding the fructose-6-phosphate phosphoketolase comprise an amino acid sequence selected from the group consisting of SEQ ID NOs: 212, 214, 216 and 218. In a further embodiment, the one or more nucleic acid molecule encoding the fructose-6-phosphate phosphoketolase is encoded by a nucleic acid sequence selected from the group consisting of SEQ ID NOs: 211, 213, 215 and 217.

Phosphate Acetyltransferase (EC 2.3.1.8)

The present disclosure describes enzymes that can catalyze the following reaction:

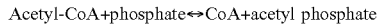

Phosphate acetyltransferase (Pta) catalyzes the reversible conversion between acetyl-CoA and acetylphosphate, a step in the metabolism of acetate. Both pyruvate and phosphoenolpyruvate activate the enzyme in the direction of acetylphosphate synthesis and inhibit the enzyme in the direction of acetyl-CoA synthesis. The acetate formation from acetyl-CoA I pathway has been the target of metabolic engineering to reduce the flux to acetate and increase the production of commercially desired end products. It has also been studied using systems biology approaches such as metabolic modeling and flux balance analysis.

Pta is composed of three domains; only the C-terminal domain is required for phosphate acetyltransferase activity. The N-terminal domain is involved in stabilization of the native quarternary structure and metabolic regulation.

Pta may be able to utilize both acetyl-CoA and propionyl-CoA. An ack pta double mutant has reduced levels of propionate from L-threonine, suggesting that the enzyme is part of the anaerobic pathway metabolizing L-threonine to propionate. A pta mutant does not grow on acetate as the sole source of carbon. Both pta and pta ackA mutants are impaired in their ability to survive glucose starvation. The growth defect of a pta mutant appears to be due to perturbation of acetyl-CoA flux. pta mutants produce large amounts of lactate when grown on glucose as the carbon source under microaerophilic conditions. The effect of a pta mutation on metabolism, enzyme activity and gene expression has been thoroughly studied recently. pta and recBC mutants are synthetically growth inhibited.

Levels of Pta are decreased by growth on acetate and under low pH conditions. pta belongs to the CreBC regulon. FNR has a slightly positive effect on pta expression. The growth-rate dependent expression pattern of pta-ackA was measured.

The pta gene that encodes the enzyme has been cloned from Clostridium acetobutylicum, sequenced and expressed in Escherichia coli. The gene is adjacent to the ackA gene, which encodes the enzyme that catalyzes the second step—acetate kinase. Enzyme activity assays performed on cell extracts from Escherichia coli and Clostridium acetobutylicum harboring the subclone showed elevated activity. The enzymes shows a decrease in specific activity when the organism reaches the solvent formation stage.

Enzymes having phosphate acetyltransferase activity or phosphate acetyltransferase genes have also been identified or measured from E. coli (eutD, pta), Roseovarius nubinhibens ISM, Clostridium kluyveri, Chlamydomonas reinhardtii (PAT2), Dasytricha ruminantium, Pelobacter acetylenicus, Gottschalkia acidurici, Lactobacillus sanfranciscensis, Paracoccus denitrificans NKNIS, Eubacterium oxidoreducens G41, Mycoplasma pneumoniae M129, Thermotoga maritima, Moorella thermoacetica, Methanosarcina thermophile, Clostridium propionicum and Fusobacterium nucleatum.

In some embodiments, an enzyme having phosphate acetyltransferase activity is encoded by an amino acid sequence having at least 70% sequence identity, at least 80% sequence identity, or at least 90% sequence identity to an enzyme having phosphate acetyltransferase activity selected from *E. coli* pta and *Clostridium acetobutylicum* pta. In a preferred embodiment, an enzyme having phosphate acetyltransferase activity is selected from *E. coli* pta and *Clostridium acetobutylicum* pta. In another embodiment, the one or more nucleic acid molecules encoding the phosphate acetyltransferase comprise an amino acid sequence selected from SEQ ID NOs: 220 and 222. In a further embodiment, the one or more nucleic acid molecule encoding the phosphate acetyltransferase is encoded by a nucleic acid sequence selected from SEQ ID NOs: 219 and 221.

Glucose-6-Phosphate 1-Dehydrogenase (EC 1.1.1.49)

The present disclosure describes enzymes that can catalyze the following reaction:

D-glucose 6-phosphate+NADP⁺↔6-phospho-D-glucono-1,5-lactone+NADPH

Glucose-6-phosphate 1-dehydrogenase may also be known as glucose-6-phosphate dehydrogenase (NADP+); NADP-glucose-6-phosphate dehydrogenase; Zwischenferment; D-glucose 6-phosphate dehydrogenase; glucose 6-phosphate dehydrogenase (NADP); NADP-dependent glucose 6-phosphate dehydrogenase; 6-phosphoglucose dehydrogenase; Entner-Doudoroff enzyme; G6PDH; GPD; glucose-6-phosphate dehydrogenase.

Glucose-6-phosphate dehydrogenase (G6PDH) is the first enzyme of the pentose phosphate pathway and provides a large fraction of the NADPH needed for anabolism.

The *E. coli* G6PDH shows a strong preference for NADP+ over NAD+. The structural basis for this preference was studied using molecular simulations, kinetic characterization of site-directed mutants and phylogenetic analyses.

Metabolic flux through the pathways of central carbon metabolism was measured using GC-MS and ¹³C labeling and 2D NMR spectroscopy. Regulation of these pathways under different growth conditions was measured at the level of enzyme expression and activity.

Substitution of an NADH-producing glucose-6-phosphate dehydrogenase for the native NADPH-producing enzyme reduced the growth rate of otherwise wild-type cells, while increasing the growth rate of a Δpgi mutant. This suggests that whether production of NADH by G6PDH is beneficial or detrimental in vivo depends on the operation of the upper Embden-Meyerhof pathway.

In addition to its role in central carbon metabolism, G6PDH was found to be the source of a linear peptide with the amino acid sequence Asn-Asn-Trp-Asn-Asn (NNWNN) that acts as an "extracellular death factor" (EDF) for MazEF-mediated cell death. The peptide acts by increasing the endoribonuclease activity of the toxins MazF and ChpBK. EDF production under stress conditions is due to cleavage of the zwf mRNA at specific ACA sites by MazF, generating a leaderless truncated mRNA. The location of the EDF-coding region with respect to the MazF cleavage sites is important, and the trans-translation system is required.

zwf is one of the most consistently flux-coupled genes, which are genes whose expression transition patterns upon perturbations are correlated with their corresponding flux values. Expression of zwf is growth rate-regulated at the transcriptional level. G6PDH activity is greater in rapidly growing cells, and is greater under nitrogen-limited compared to carbon-limited growth conditions. zwf is a part of the SoxRS regulon which responds to superoxide stress. Additional regulators have been shown to activate transcription of zwf. Exposure to tellurite activates transcription of zwf and thereby increases the synthesis of NADPH.

A zwf null mutation does not affect the growth rate significantly. However, central carbon metabolism and metabolic flux is changed. A pgi zwf double mutant does not grow on glucose as the sole source of carbon. In the presence of glucose, it accumulates high levels of glucose-6-phosphate, which inhibits fructose-1,6-bisphosphatase I activity. Deletion of zwf reduces the organic solvent tolerance of *E. coli* JM109.

In some embodiments, a recombinant microorganism producing MEG or glycolic acid, or MEG and one or more co-product, comprises a deletion, insertion, or loss of function mutation in a gene encoding a glucose-6-phosphate dehydrogenase to prevent the flux of glucose-6-phosphate through the oxidative branch of the pentose phosphate pathway and instead shunt glucose-6-phosphate through the non-oxidative branch of the pentose phosphate pathway to produce D-ribose-5-phosphate intermediate.

6-Phosphogluconolactonase (EC 3.1.1.31)

The present disclosure describes enzymes that can catalyze the following reaction:

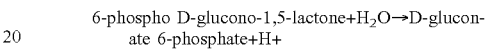
6-phospho D-glucono-1,5-lactone+H₂O→D-gluconate 6-phosphate+H+

6-phosphogluconolactonase may also be known as phosphogluconolactonase; 6-PGL.

6-phosphogluconolactonase is an enzyme of the oxidative pentose phosphate pathway.

A pgl mutant strain grows only slightly slower than wild type on glucose as the sole source of carbon. Growth on glucose may be due to non-enzymatic hydrolysis of 6-phospho D-glucono-1,5-lactone or a bypass pathway that involves dephosphorylation and export of gluconolactone, hydrolysis to gluconate, followed by gluconate re-import and phosphorylation. When grown on maltose medium, strains lacking Pgl activity turn blue after iodine treatment. The phenotype of a pgl deletion strain can be complemented by expression of the pgl gene from *Pseudomonas putida*, although there is no detectable similarity between the two genes.

A strategy for metabolic engineering of *E. coli* for the production of riboflavin included overexpression of pgl, leading to an increase in riboflavin titer.

pgl is part of a genomic region that is deleted in the *E. coli* B strain BL21, but is present in the K-12 strain MG1655.

In some embodiments, a recombinant microorganism producing MEG or glycolic acid, or MEG and one or more co-product, comprises a deletion, insertion, or loss of function mutation in a gene encoding a 6-phosphogluconolactonase to prevent the flux of glucose-6-phosphate through the oxidative branch of the pentose phosphate pathway and instead shunt glucose-6-phosphate through the non-oxidative branch of the pentose phosphate pathway to produce D-ribose-5-phosphate intermediate.

6-Phosphogluconate Dehydrogenase, Decarboxylating (EC 1.1.1.44)

The present disclosure describes enzymes that can catalyze the following reaction:

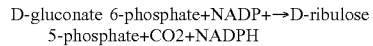
D-gluconate 6-phosphate+NADP+→D-ribulose 5-phosphate+CO2+NADPH 6-phosphogluconate dehydrogenase may also be known as phosphogluconate dehydrogenase (NADP+-dependent, decarboxylating); phosphogluconic acid dehydrogenase; 6-phosphogluconic dehydrogenase; 6-phosphogluconic carboxylase; 6-phospho-D-gluconate dehydrogenase; glyceraldehyde 3-phosphate dehydrogenase.

6-phosphogluconate dehydrogenase is an enzyme of the oxidative branch of the pentose phosphate pathway.

Three crystal structures of the enzyme in complex with substrate and cosubstrate compounds have been solved.

Binding of NADP+ may induce a conformational change in the enzyme. A catalytic mechanism has been proposed.

gnd is a highly polymorphic gene within *E. coli* populations, likely due to interstrain transfer and recombination. This may be a result of its proximity to the rib region, which determines 0 antigen structure.

Expression of 6-phosphogluconate dehydrogenase is growth rate-regulated. Most of the growth rate-dependent increase in Gnd levels is due to increased transcription, leading to higher mRNA levels. Posttranscriptional regulation involves a secondary structure element between codons 67 and 78 of the gnd mRNA. This region may function by sequestration of the translation initiation region into an mRNA secondary structure, thus reducing the efficiency of translation initiation. However, the effector of this regulatory mechanism has apparently not yet been identified. truA (hisT) mutants reduce the growth rate-dependent increase of Gnd expression by post-transcriptional regulation. Growth under acidic conditions upregulates expression of gnd. gnd is one of the most consistently flux-coupled genes (FCGs), which are genes whose expression transition patterns upon perturbations are correlated with their corresponding flux values.

Certain growth conditions selected for a deletion mutation in the promoter region that results in increased transcription of gnd and increased enzyme activity. An edd gnd double mutant is unable to grow on gluconate. A null mutation in gnd does not significantly alter the growth rate. However, cellular metabolism and metabolic flux is changed; succinate production is increased during growth on glucose or glycerol. A gnd deletion mutant shows enhanced ethanol and $H_2$ production compared to wild type during anaerobic growth on glycerol, whereas in a different, heavily engineered strain, overexpression of gnd increases ethanol and $H_2$ production.

In some embodiments, a recombinant microorganism producing MEG or glycolic acid, or MEG and one or more co-product, comprises a deletion, insertion, or loss of function mutation in a gene encoding a 6-phosphogluconate dehydrogenase to prevent the flux of glucose-6-phosphate through the oxidative branch of the pentose phosphate pathway and instead shunt glucose-6-phosphate through the non-oxidative branch of the pentose phosphate pathway to produce D-ribose-5-phosphate intermediate.

Glyceraldehyde 3-Phosphate Dehydrogenase, Phosphorylating (EC 1.2.1.12)

The present disclosure describes enzymes that can catalyze the following reaction:

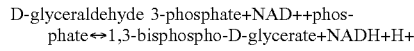

D-glyceraldehyde 3-phosphate+NAD++phosphate↔1,3-bisphospho-D-glycerate+NADH+H+

Glyceraldehyde 3-phosphate dehydrogenase may also be known as glyceraldehyde-3-phosphate dehydrogenase (phosphorylating); triosephosphate dehydrogenase; dehydrogenase, glyceraldehyde phosphate; phosphoglyceraldehyde dehydrogenase; 3-phosphoglyceraldehyde dehydrogenase; NAD+-dependent glyceraldehyde phosphate dehydrogenase; glyceraldehyde phosphate dehydrogenase (NAD+); glyceraldehyde-3-phosphate dehydrogenase (NAD+); NADH-glyceraldehyde phosphate dehydrogenase; glyceraldehyde-3-P-dehydrogenase.

Glyceraldehyde 3-phosphate dehydrogenase A catalyzes the reversible oxidative phosphorylation of D-glyceraldehyde-3-phosphate to 1,3-bisphospho-D-glycerate in the presence of NAD+ and phosphate during glycolysis and gluconeogenesis in *E. coli*. The enzyme is also found in many other organisms and its properties have been extensively studied.

*E. coli* is unusual in having two glyceraldehyde-3-phosphate dehydrogenase (GAPDH) activities encoded by gapA and epd (gapB). However, the gapA encoded enzyme has a highly efficient phosphorylating glyceraldehyde-3-phosphate dehydrogenase activity and a low phosphorylating erythrose-4-phosphate dehydrogenase activity, whereas the epd encoded enzyme has an efficient non-phosphorylating erythrose-4-phosphate dehydrogenase activity and a very low phosphorylating glyceraldehyde-3-phosphate dehydrogenase activity.

The GapA protein has a sequence that is more similar to eukaryotic sequences than to the thermophilic bacterial enzymes, and to prokaryotic enzymes in general. The gapA product is required for glycolysis, while the epd product is not. Both enzymes may be involved in production of pyridoxal 5'-phosphate (PLP).

Early studies of gapA mutants from *E. coli* K-10 implicated its role in glycolysis and demonstrated some of its catalytic properties. A gapA mutant exhibits a growth defect and also exhibits increased aggregation and lysis phenotypes that are rescued by high-salt media.

Regulation of gapA gene expression has been studied. The regulation of the fkpA, gapA, and hslT genes is affected by evolution under conditions of chronic heat stress.

The *E. coli* sequence contains several amino acids that are conserved in all GAPDHs and are postulated to be involved in NAD+ binding, or the catalytic mechanism.

The crystal structure of the wild-type enzyme in the presence of NAD+ has been determined at 1.80 Å resolution and was similar to those of other GAPDHs. The crystal structure of a N313T mutant was also determined at 2.17 Å resolution. Several other *E. coli* GAPDH crystal structures have been reported with and without bound NAD+, and in the hemiacetal intermediate state.

Molecular factors responsible for the NAD+ cofactor stereospecificity have been studied using site-directed mutagenesis. The enzyme is a B-specific dehydrogenase that catalyzes transfer of the pro-S hydrogen and binds NAD(H) in the syn nicotinamide orientation. Refolding of denatured *E. coli* GAPDH in the presence of chaperone protein Tig; trigger factor has been studied.

ADP-ribosylated GAPDH is a secreted virulence factor in some fungi and Gram-positive pathogens, as well as in pathogenic strains of *E. coli*. Non-pathogenic *E. coli* do not secrete GAPDH. Evidence suggests that *E. coli* GAPDH is also involved in DNA repair.

A series of vectors inducibly expressing paired-terminus antisense RNAs was constructed to silence central carbon metabolism in host *E. coli* K-12 MG1655. A vector that silenced gapA at 93% efficacy caused severe growth inhibition. Regulating the expression of an engineered *E. coli* gapA through changes in temperature has been demonstrated to control glycolysis.

In some embodiments, a recombinant microorganism producing MEG or glycolic acid, or MEG and one or more co-product, comprises a deletion, insertion, or loss of function mutation in a gene encoding a glyceraldehyde 3-phosphate dehydrogenase to prevent the conversion of glyceraldehyde 3-phosphate to 1,3-bisphospho-D-glycerate and instead allow glyceraldehyde 3-phosphate to be converted to xylulose-5-phosphate (with a concurrent conversion of fructose-6-phosphate to erythrose-4-phosphate) by a transketolase, which can be further converted to D-ribose 5-phosphate, an intermediate in the non-oxidative pentose phosphate pathway, which can be converted by a D-ribose 5-phosphate aldolase into the intermediates glycoladehyde and D-glyceraldehyde 3-phosphate (G3P) for the production of MEG or glycolic acid, or MEG and one or more co-product.

Pentose-Phospohate Aldolase

Pentose-phosphate aldolases catalyze the reversible aldol reaction converting a pentose-phosphate into glyceraldehyde-3-phosphate and glycoaldehyde. In some embodiments, the pentose-phosphate aldolase is a D-ribose-5-phosphate aldolase (DERA), a D-ribulose-5-phosphate aldolase, or a D-xylulose-5-phosphate aldolase.

In some embodiments a D-ribose-5-phosphate aldolase cataylses the conversion of D-ribose-5-phosphate to acetaldehyde and glyceraldehyde-3-phosphate.

In some embodiments a D-ribulose-5-phosphate aldolase cataylses the conversion of D-ribulose-5-phosphate to a glycoaldehyde and glyceraldehyde-3-phosphate.

In some embodiments a D-xylulose-5-phosphate aldolase cataylses the conversion of D-xylulose-5-phosphate to a glycoaldehyde and glyceraldehyde-3-phosphate.

In some embodiments the pentose-phosphate aldolase is derived from *Escherichia Coli*. In some embodiments the pentose-phosphate aldolase is derived from *Bacillus* caldolyticus.

In some embodiments the *E. coli* pentose-phosphate aldolase is encoded by a nucleic acid sequence comprising:

```
                                      (SEQ ID NO: 255)
ATGACTGATC TGAAAGCAAG CAGCCTGCGT GCACTGAAAT

TGATGGACCT GACCACCCTG AATGACGACG ACACCGACGA

GAAAGTGATC GCCCTGTGTC ATCAGGCCAA AACTCCGGTC

GGCAATACCG CCGCTATCTG TATCTATCCT CGCTTTATCC

CGATTGCTCG CAAAACTCTG AAAGAGCAGG GCACCCCGGA

AATCCGTATC GCTACGGTAA CCAACTTCCC ACACGGTAAC

GACGACATCG ACATCGCGCT GGCAGAAACC CGTGCGGCAA

TCGCCTACGG TGCTGATGAA GTTGACGTTG TGTTCCCGTA

CCGCGCGCTG ATGGCGGGTA ACGAGCAGGT CTGGTGAAAG

CCTGTAAAGA GGCTTGCGCG GCAGCGAATG TACTGCTGAA

AGTGATCATC GAAACCGGCG AACTGAAAGA CGAAGCGCTG

ATCCGTAAAG CGTCTGAAAT CTCCATCAAAGCGGGTGCGG

ACTTCATCAA AACCTCTACC GGTAAAGTGG CTGTGAACGC

GACGCCGGAA AGCGCGCGCA TCATGATGGA AGTGATCCGT

GATATGGGCG TAGAAAAAAC CGTTGGTTTC AAACCGGCGG

GCGGCGTGCG TACTGCGGAA GATGCGCAGA AATATCTCGC

CATTGCAGAT GAACTGTTCG GTGCTGACTG GGCAGATGCG

CGTCACTACC GCTTTGGCGC TTCCAGCCTG CTGGCAAGCC

TGCTGAAAGC GCTGGGTCAC GGCGACGGTA AGAGCGCCAG

CAGCTACTAA.
```

In some embodiments, the *E. coli* pentose-phosphate aldolase is an amino acid sequence comprising:

```
                                      (SEQ ID NO: 256)
MTDLKASSLRALKLMDLTTLNDDDTDEKVIALCHQAKTPVGNTAAICIYP

RFIPIARKTLKEQGTPEIRIATVTNFPHGNDDIDIALAETRAAIAYGADE

VDVVFPYRALMAGNEQVGFDLVKACKEACAAANVLLKVIIETGELKDEAL

IRKASEISIKAGADFIKTSTGKVAVNATPESARIMMEVIRDMGVEKTVGF

KPAGGVRTAEDAQKYLAIADELFGADWADARHYRFGASSLLASLLKALGH

GDGKSASSY.
```

In some embodiments the *E. coli* pentose-phosphate aldolase comprises a C47N mutation and is encoded by a nucleic acid sequence comprising:

```
                                      (SEQ ID NO: 255)
ATGACTGATCTGAAAGCAAGCAGCCTGCGTGCACTGAAATTGATGGACCT

GACCACCCTGAATGACGACGACACCGACGAGAAAGTGATCGCCCTGTGTC

ATCAGGCCAAAACTCCGGTCGGCAATACCGCCGCTATCAATATCTATCCT

CGCTTTATCCCGATTGCTCGCAAAACTCTGAAAGAGCAGGGCACCCCGGA

AATCCGTATCGCTACGGTAACCAACTTCCCACACGGTAACGACGACATCG

ACATCGCGCTGGCAGAAACCCGTGCGGCAATCGCCTACGGTGCTGATGAA

GTTGACGTTGTGTTCCCGTACCGCGCGCTGATGGCGGGTAACGAGCAGGT

TGGTTTTGACCTGGTGAAAGCCTGTAAAGAGGCTTGCGCGGCAGCGAATG

TACTGCTGAAAGTGATCATCGAAACCGGCGAACTGAAAGACGAAGCGCTG

ATCCGTAAAGCGTCTGAAATCTCCATCAAAGCGGGTGCGGACTTCATCAA

AACCTCTACCGGTAAAGTGGCTGTGAACGCGACGCCGGAAAGCGCGCGCA

TCATGATGGAAGTGATCCGTGATATGGGCGTAGAAAAAACCGTTGGTTTC

AAACCGGCGGGCGGCGTGCGTACTGCGGAAGATGCGCAGAAATATCTCGC

CATTGCAGATGAACTGTTCGGTGCTGACTGGGCAGATGCGCGTCACTACC

GCTTTGGCGCTTCCAGCCTGCTGGCAAGCCTGCTGAAAGCGCTGGGTCAC

GGCGACGGTAAGAGCGCCAGCAGCTACTAA.
```

In some embodiments the *B. caldolyticus* pentose-phosphate aldolase is encoded by a nucleic acid sequence having at least 70% sequence identity, at least 80% sequence identity, or at least 90% sequence identity to:

```
                                      (SEQ ID NO: 286)
ATGACGATGAATATCGCGAAAATGATCGATCATACGCTGCTCAAACCGGA

AGCGACAGAACAACAAATCGTGCAACTGTGCACGGAAGCAAAGCAATACG

GCTTTGCTGCCGTGTGCGTCAACCCAACGTGGGTGAAAACGGCGGCGCGC

GAGCTTTCCGGCACGGATGTCCGCGTCTGCACGGTCATCGGCTTTCCACT

TGGGGCAACGACGCCGGAAACAAAGGCGTTTGAAACAACGAACGCCATCG

AAAACGGCGCTCGCGAAGTCGACATGGTGATCAACATCGGTGCGTTAAAA

AGCGGGCAAGACGAGCTTGTCGAGCGCGACATTCGTGCGGTTGTCGAAGC

GGCGGCTGGCAGGGCGCTTGTCAAAGTGATCGTTGAAACGGCGCTTTTGA

CCGATGAGGAAAAAGTGCGCGCCTGCCAGCTCGCAGTGAAAGCCGGCGCT
```

```
GATTATGTGAAAACGTCGACCGGGTTTTCCGGCGGAGGTGCGACGGTGGA

GGATGTGGCGCTGATGCGGAAAACGGTCGGCGACAGAGCAGGCGTCAAAG

CATCAGGCGGCGTCCGTGACTGGAAAACCGCTGAGGCGATGATCAACGCC

GGCGCGACGCGCATCGGCACAAGCTCTGGGGTGGCGATCGTCACCGGCGG

GACGGGCCGCGCTGACTACTAA.
```

In some embodiments the *B. caldolyticus* pentose-phosphate aldolase is encoded by a cDNA optimized sequence comprising a nucleic acid sequence having at least 70% sequence identity, at least 80% sequence identity, or at least 90% sequence identity to:

```
                                    (SEQ ID NO: 287)
CCATGGCAAACATCGCGAAGATGATTGACCACACCCTGCTGAAACCG

GAGGCGACCGAACAGCAAATCGTTCAGCTGTGCACCGAGGCGAAACAAT

ACGGCTTCGCGGCGGTGTGCGTTAACCCGACCTGGGTTAAGACCGCGGC

GCGTGAACTGAGCGGTACCGACGTGCGTGTTTGCACCGTGATTGGTTTC

CCGCTGGGTGCGACCACCCCGGAGACCAAAGCGTTTGAAACCACCAACG

CGATTGAGAACGGCGCGCGTGAAGTTGATATGGTGATCAACATTGGCGC

GCTGAAGAGCGGTCAGGACGAGCTGGTTGAGCGTGATATTCGTGCGGTG

GTTGAGGCTGCGGCGGGTCGTGCGCTGGTGAAAGTTATTGTGGAAACCG

CGCTGCTGACCGACGAGGAAAAAGTGCGTGCGTGCCAACTGGCGGTTAA

GGCGGGTGCGGATTACGTGAAAACCAGCACCGGTTTTAGCGGTGGCGGT

GCGACCGTTGAGGATGTGGCGCTGATGCGTAAGACCGTTGGCGATCGTG

CGGGTGTGAAAGCGAGCGGCGGTGTTCGTGACTGGAAGACCGCGGAAGC

GATGATCAACGCGGGTGCGACCCGTATTGGTACCAGCAGCGGTGTTGCG

ATTGTGACCGGCGGTACCGGTCGTGCGGATTATAAGCTT.
```

In some embodiments, the *E. coli* pentose-phosphate aldolase is an amino acid sequence having at least 70% sequence identity, at least 80% sequence identity, or at least 90% sequence identity to:

```
                                    (SEQ ID NO: 256)
MTDLKASSLRALKLMDLTTLNDDDTDEKVIALCHQAKTPVGNTAAICI

YPRFIPIARKTLKEQGTPEIRIATVTNFPHGNDDIDIALAETRAAIAY

GADEVDVVFPYRALMAGNEQVGFDLVKACKEACAAANVLLKVIIETGE

LKDEALIRKASEISIKAGADFIKTSTGKVAVNATPESARIMMEVIRDM

GVEKTVGFKPAGGVRTAEDAQKYLAIADELFGADWADARHYRFGASSL

LASLLKALGHGDGKSASSY.
```

In some embodiments, the *E. coli* pentose-phosphate aldolase is an amino acid sequence comprises a C47N mutation and comprises:

```
                                    (SEQ ID NO: 299)
MTDLKASSLRALKLMDLTTLNDDDTDEKVIALCHQAKTPVGNTAAINI

YPRFIPIARKTLKEQGTPEIRIATVTNFPHGNDDIDIALAETRAAIAY

GADEVDVVFPYRALMAGNEQVGFDLVKACKEACAAANVLLKVIIETGE

LKDEALIRKASEISIKAGADFIKTSTGKVAVNATPESARIMMEVIRDM

GVEKTVGFKPAGGVRTAEDAQKYLAIADELFGADWADARHYRFGASSL

LASLLKALGHGDGKSASSY.
```

In some embodiments, *B. caldolyticus* pentose-phosphate aldolase is an amino acid sequence having at least 70% sequence identity, at least 80% sequence identity, or at least 90% sequence identity to:

```
                                    (SEQ ID NO: 297)
MTMNIAKMIDHTLLKPEATEQQIVQLCTEAKQYGFAAVCVNPTWVKTA

ARELSGTDVRVCTVIGFPLGATTPETKAFETTNAIENGAREVDMVINI

GALKSGQDELVERDIRAVVEAAAGRALVKVIVETALLTDEEKVRACQL

AVKAGADYVKTSTGFSGGGATVEDVALMRKTVGDRAGVKASGGVRDWK

TAEAMINAGATRIGTSSGVAIVTGGTGRADY
```

In some embodiments the *B. caldolyticus* pentose-phosphate aldolase comprises a mutation C37N mutation and is encoded by a nucleic acid sequence having at least 70% sequence identity, at least 80% sequence identity, or at least 90% sequence identity to:

```
                                    (SEQ ID NO: 286)
ATGACGATGAATATCGCGAAAATGATCGATCATACGCTGCTGAAACCG

GAAGCGACAGAACAACAAATCGTGCAACTGTGCACGGAAGCAAAGCAA

TACGGCTTTGCTGCCGTGTGCGTCAACCCAACGTGGGTGAAAACGGCG

GCGCGCGAGCTTTCCGGCACGGATGTCCGCGTCTGCACGGTCATCGGC

TTTCCACTTGGGGCAACGACGCCGGAAACAAAGGCGTTTGAAACAACG

AACGCCATCGAAAACGGCGCTCGCGAAGTCGACATGGTGATCAACATC

GGTGCGTTAAAAAGCGGGCAAGACGAGCTTGTCGAGCGCGACATTCGT

GCGGTTGTCGAAGCGGCGGCTGGCAGGGCGCTTGTCAAAGTGATCGTT

GAAACGGCGCTTTTGACCGATGAGGAAAAAGTGCGCGCCTGCCAGCTC

GCAGTGAAAGCCGGCGCTGATTATGTGAAAACGTCGACCGGGTTTTCC

GGCGGAGGTGCGACGGTGGAGGATGTGGCGCTGATGCGGAAAACGGTC

GGCGACAGAGCAGGCGTCAAAGCATCAGGCGGCGTCCGTGACTGGAAA

ACCGCTGAGGCGATGATCAACGCCGGCGCGACGCGCATCGGCACAAGC

TCTGGGGTGGCGATCGTCACCGGCGGGACGGGCCGCGCTGACTACTA

A.
```

In some embodiments, *B. caldolyticus* pentose-phosphate aldolase comprises a mutation C37N mutation and is an amino acid sequence having at least 70% sequence identity, at least 80% sequence identity, or at least 90% sequence identity to:

```
                                    (SEQ ID NO: 298)
MTMNIAKMIDHTLLKPEATEQQIVQLCTEAKQYGFAAVNVNPTWVKTA

ARELSGTDVRVCTVIGFPLGATTPETKAFETTNAIENGAREVDMVINI

GALKSGQDELVERDIRAVVEAAAGRALVKVIVETALLTDEEKVRACQL
```

-continued
AVKAGADYVKTSTGFSGGGATVEDVALMRKTVGDRAGVKASGGVRDWK

TAEAMINAGATRIGTSSGVAIVTGGTGRADY

6-Phosphofructokinase (EC 2.7.1.11)

Phosphofructokinase (Pfk) catalyzes the phosphorylation of fructose-6-phosphate on the C1 carbon during glycolysis. *E. coli* contains two Pfk isozymes, Pfk-1 (pfkA) and Pfk-2 (pfkB), which do not share sequence similarity. More than 90% of the phosphofructokinase activity present in wild type *E. coli* can be attributed to Pfk-1.

PfkA catalyzes the phosphorylation of fructose-6-phosphate and is a key enzyme regulating the glycolysis pathway. The enzyme cannot catalyze the reverse reaction in vivo. The enzyme shows cooperative kinetics with the substrate fructose-6-phosphate, but not with the other substrate, ATP. Recently, it was shown that PfkA also catalyzes phosphorylation of sedoheptulose-7-phosphate as part of the sedoheptulose bisphosphate bypass. Crystal structures of PfkA have been solved with and without activators and inhibitors. Based on sequence similarity, PfkA was predicted to be an NAD+ kinase.

PfkB is a member of the ribokinase family of sugar kinases. PfkB, unlike PfkA, does not show cooperative interaction with fructose-6-phosphate, inhibition by PEP or activation by ADP. $MgATP^{2-}$ is the true substrate of the enzyme. PfkB can also use tagatose-6-phosphate as a substrate. This reaction is part of the galactitol catabolism pathway. A crystal structure of PfkB in the tetrameric form inhibited by MgATP has been solved at 1.98 Å resolution. Comparison of this structure with a crystal structure of PfkB in complex with fructose-6-phosphate suggests negative interplay between fructose-6-phosphate binding and MgATP binding.

In some embodiments, a recombinant microorganism producing MEG or glycolic acid, or MEG and one or more co-product, comprises a deletion, insertion, or loss of function mutation in a gene encoding a 6-phosphofructokinase to prevent the conversion of fructose-6-phosphate to 1,6-bisphosphate and instead allow fructose-6-phosphate to be converted to erythrose-4-phosphate and acetyl-phosphate by a fructose-6-phosphate phosphoketolase, and provide more erythrose-4-phosphate for the non-oxidative branch of the pentose phosphate pathway to further produce D-ribose 5-phosphate intermediate, which can be converted by a D-ribose 5-phosphate aldolase into the intermediates glycoladehyde and D-glyceraldehyde 3-phosphate (G3P) needed for the production of MEG or glycolic acid, or MEG and one or more co-product. In some embodiments, the 6-phosphofructokinase is pfkA and/or pfkB.

Hydroxypyruvate Decarboxylase, 2-Oxoglutarate Decarboxylase, 2-Keto Acid Decarboxylase (EC 4.1.1.-)

The present disclosure describes enzymes that can catalyze the following reactions:

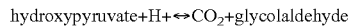

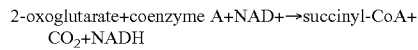

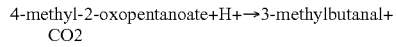

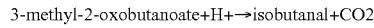

Hydroxypyruvate decarboxylase may also be known as hydroxypyruvate carboxy-lyase.

2-oxoglutarate decarboxylase may also be known as oxoglutarate decarboxylase; alpha-ketoglutarate decarboxylase; alpha-ketoglutaric decarboxylase; pre-2-oxoglutarate decarboxylase; 2-oxoglutarate carboxy-lyase.

*E. coli* SucA is responsible for the 2-oxoglutarate decarboxylase activity of the 2-oxoglutarate dehydrogenase multienzyme complex (OGDHC) that catalyzes the conversion of 2-oxoglutarate (2-ketoglutarate) to succinyl-CoA and $CO_2$, with the production of NADH.

The OGDHC is a member of the 2-oxo acid dehydrogenase family.

Members of this family contain multiple copies of three enzymatic components: 2-oxoglutarate decarboxylase (E1), lipoamide acyltransferase (E2) and lipoamide dehydrogenase (E3). In most Gram-positive bacteria and in mitochondria the E1 component is a heterodimer composed of two subunits, while in most (but not all) Gram-negative bacteria it is made up of a single type of subunit. In both cases multiple copies of the E1 component along with multiple copies of the E3 component are assembled around an E2 core of 24 subunits with octahedral symmetry, or 60 subunits with eicosahedral symmetry (depending on which complex and species). In *E. coli* the E3 component is shared with the pyruvate dehydrogenase and glycine cleavage multi-enzyme complexes. E1 and E2 differ slightly for the 2-oxoglutarate and pyruvate dehydrogenase complexes, and are designated (o) and (p) to distinguish them.

The *E. coli* OGDHC contains 12 units of the E1(o) component 2-oxoglutarate decarboxylase, thiamine-requiring encoded by sucA, 24 units of the E2(o) component dihydrolipoyltranssuccinylase encoded by sucB, and 2 units of the E3 component lipoamide dehydrogenase encoded by lpd. The 24 E2(o) units form the octahedral core of the complex. They contain lipoyllysine and binding sites for dimers of the E1(o) and E3 subunits. Electron cryotomography showed that they are flexibly tethered to the E2 core.

During the OGDHC reaction cycle, 2-oxoglutarate is bound and decarboxylated by SucA, a thiamin-diphosphate cofactor containing enzyme. The crystal structure of a truncated, apo form of SucA lacking the N-terminal 77 residues has been determined at 2.6 Å resolution. The structure of the holo form with thiamin diphosphate and $Mg^{2+}$ was determined at 3.5 Å resolution. The truncated form retained decarboxylase activity but did not assemble with E2(o) into an OGDH complex. Data also suggested the presence of an AMP binding site. An oxygen-dependent thiamin free radical was demonstrated in the OGDHC, which was generated by a side reaction with $O_2$.

Studies of engineered SucA prepared by saturation mutagenesis of His260 and His298 suggested that His260 is required for substrate recognition, but His298 could be replaced by hydrophobic residues of similar size. Data also suggested that E2(o) has a role in specificity.

The sucA gene was cloned and sequenced in earlier work and regulation of sucABCD was studied. The sucAB and sucCD genes were shown to be mutually essential, with either pair sufficient to produce succinyl-CoA, but simultaneous deletion of sucAB and sucCD was not viable.

α-ketoisovalerate decarboxylase catalyzes the decarboxylation of 3-methyl-2-oxobutanoate to isobutanal. The enzyme is highly specific for 3-methyl-2-oxobutanoate, but also shows activity with other branched-chain 2-keto acids (4-methyl-2-oxopentanoate, 22.7% relative activity; (S)-3-methyl-2-oxopentanoate, 16.7%, 2-oxo-3-phenylpropanoate, 7.1% and 4-(methylthio)-2-oxobutanoate, 5.8%.

The enzyme is a homo-tetramer, encoded by the kivd gene, which has been sequenced and cloned. The deduced protein sequence shares 98.6% identity (over its first 438 amino acids) with an *L. lactis* strain IL1403 protein, encoded by the ipd gene (this gene is interrupted at position L439 by the insertion of an IS983 element). The kivd gene does not have any homology with any gene(s) in the sequenced genomes of *L. lactis* strains MG1363 and SK11.

A study of the Kivd activity testing 156 lactic acid bacteria strains (*Lactococcus, Lactobacillus, Leuconostoc*) indicated that only *L. lactis* strains possess the activity, and even within lactococcal strains, only 7 out of 45 strains had the activity.

A homologous protein has been described from *L. lactis* strain B1157 as branched-chain α-keto acid decarboxylase. That protein shows 89.8% identity with Kivd and also has a preference for 2-keto-isovalerate.

In some embodiments, an enzyme having 2-keto acid decarboxylase activity, an enzyme having hydroxypyruvate decarboxylase activity or an enzyme having 2-oxoglutarate decarboxylase activity converts hydroxypyruvate to glycolaldehyde. In some embodiments, the enzyme that converts hydroxypyruvate to glycolaldehyde is encoded by an amino acid sequence having at least 70% sequence identity, having at least 80% sequence identity, or having at least 90% sequence identity to Kivd or SucA. In some embodiments, the enzyme having 2-keto acid decarboxylase activity is Kivd. In some embodiments, the enzyme having 2-oxoglutarate decarboxylase activity is SucA.

In some embodiments, the one or more nucleic acid molecules encoding the enzyme having 2-oxoglutarate decarboxylase activity is sucA, or homolog thereof. In some embodiments, the one or more nucleic acid molecules encoding the enzyme having 2-keto acid decarboxylase activity is Kivd, or homolog thereof. In another embodiment, the one or more nucleic acid molecules encoding an enzyme having 2-keto acid decarboxylase activity, an enzyme having hydroxypyruvate decarboxylase activity or an enzyme having 2-oxoglutarate decarboxylase activity comprise an amino acid sequence selected from SEQ ID NOs: 224 and 226. In a further embodiment, the one or more nucleic acid molecule encoding an enzyme having 2-keto acid decarboxylase activity, an enzyme having hydroxypyruvate decarboxylase activity or an enzyme having 2-oxoglutarate decarboxylase activity is encoded by a nucleic acid sequence selected from SEQ ID NOs: 223 and 225.

2-Oxoglutarate Reductase, 3-Phospho-Hydroxypyruvate Reductase, 3-Phosphoglycerate Dehydrogenase (EC 1.1.1.-)

The present disclosure describes enzymes that can catalyze the following reactions:

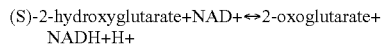
(S)-2-hydroxyglutarate+NAD+↔2-oxoglutarate+ NADH+H+

3-phospho-D-glycerate+NAD+↔3-phospho-hydroxy-pyruvate+NADH+H+

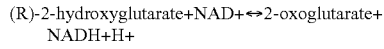
(R)-2-hydroxyglutarate+NAD+↔2-oxoglutarate+ NADH+H+

3-phosphoglycerate dehydrogenase may also be known as phosphoglycerate dehydrogenase; PHGDH (gene name); D-3-phosphoglycerate: NAD+ oxidoreductase; alpha-phosphoglycerate dehydrogenase; 3-phosphoglyceric acid dehydrogenase; D-3-phosphoglycerate dehydrogenase; glycerate 3-phosphate dehydrogenase; glycerate-1,3-phosphate dehydrogenase; phosphoglycerate oxidoreductase; phosphoglyceric acid dehydrogenase; SerA; 3-phosphoglycerate:NAD+ 2-oxidoreductase; SerA 3PG dehydrogenase; 3PHP reductase.

3-phosphoglycerate dehydrogenase catalyzes the first committed step in the biosynthesis of L-serine. The enzyme is regulated by allosteric end-product inhibition that shows cooperativity. Inhibition by serine acts primarily through reduction of catalytic velocity and has only a small effect on the Kms of the substrates; SerA is thus classified as a type V allosteric enzyme.

The basis for allosteric and cooperative inhibition by serine has been studied extensively. Occupation of two of the four serine binding sites in the homotetramer results in 85% inhibition of activity. Further binding of serine shows negative cooperativity. Phosphate is able to reduce the site-to-site cooperative effects on serine binding; the effect was mainly due to the presence of intrinsically bound NADH. A Trp139Gly mutation results in a homodimeric enzyme that has lost cooperativity in serine binding and allosteric inhibition. Site-directed mutagenesis of residues within the effector binding site, the regulatory interface between subunits, and a flexible hinge region support a model where movement of adjacent domains is involved in inhibition of the enzymatic activity. Transient kinetic analysis showed that the cooperativity of inhibition of catalytic activity results from a conformational change due to serine binding. An enzyme missing the regulatory domain is no longer inhibited by serine, but other kinetic parameters remain the same. Hybrid tetramers provided further insight into the mechanism of allosteric inhibition.

Site-directed mutagenesis has allowed the identification of residues within the active site that contribute to substrate binding and catalysis. Mutations in the hinge region between the substrate and nucleotide binding domains affect the kcat of the enzyme; certain mutations uncouple serine binding and catalytic inhibition.

Extensive site-directed mutagenesis and structural studies have contributed to a detailed view of the interactions between allosteric regulation, cooperativity and catalytic activity. Further insight into the catalytic pathway was provided by stopped-flow kinetic analysis, indicating that the rate-limiting step in both catalytic directions is a conformational change of the enzyme. Serine binding appears to lead to the formation of a dead-end quaternary complex between the enzyme, coenzyme, substrate, and effector that eliminates the conformational change subsequent to substrate binding.

The enzyme has been shown to also have an α-ketoglutarate reductase activity, producing 2-hydroxyglutarate. While the metabolic role of this reaction is not yet known, it is thought that it may play a role in regulating serine biosynthesis and in recycling NADH back to NAD+, especially during anaerobiosis.

Crystal structures of the wild type enzyme and various mutants have been solved. The structure showed that each subunit of the homotetramer consists of three distinct domains, a nucleotide binding domain, a substrate binding domain, and a regulatory/serine binding domain.

serA is essential for growth on glycerol minimal medium; the growth defect can be rescued by addition of serine.

In some embodiments, the enzyme having 3-phosphoglycerate dehydrogenase activity can be an enzyme having 3-phospho-hydroxypyruvate reductase activity or an enzyme having 2-oxoglutarate reductase activity. In some embodiments, an enzyme having 3-phosphoglycerate dehydrogenase activity, an enzyme having 3-phospho-hydroxypyruvate reductase activity, or an enzyme having 2-oxoglutarate reductase activity catalyzes the conversion of glycerate 3-phophate to 3-phosphohydroxypyruvate. In some embodiments, an enzyme having 3-phosphoglycerate dehydrogenase activity, an enzyme having 3-phospho-hydroxypyruvate reductase activity, or an enzyme having 2-oxoglutarate reductase activity is encoded by an amino acid sequence having at least 70% sequence identity, having at least 80% sequence identity, or having at least 90% sequence identity to serA. In some embodiments, the enzyme having 3-phosphoglycerate dehydrogenase activity, the enzyme having 3-phospho-hydroxypyruvate reductase activity, or the enzyme having 2-oxoglutarate reductase activity is serA.

In some embodiments, the one or more nucleic acid molecules encoding the enzyme having 3-phosphoglycerate dehydrogenase activity is serA, or homolog thereof. In another embodiment, the one or more nucleic acid molecules encoding an enzyme having 3-phosphoglycerate dehydrogenase activity, an enzyme having 3-phospho-hydroxypyruvate reductase activity, or an enzyme having 2-oxoglutarate reductase activity comprises an amino acid sequence set forth in SEQ ID NO: 228. In a further embodiment, the one or more nucleic acid molecule encoding an enzyme having 3-phosphoglycerate dehydrogenase activity, an enzyme having 3-phospho-hydroxypyruvate reductase activity, or an enzyme having 2-oxoglutarate reductase activity is encoded by a nucleic acid sequence set forth in SEQ ID NO: 227.

3-Phosphoserine Aminotransferase, Serine Aminotransferase, L-Serine Transaminase (EC 2.6.1.52)

The present disclosure describes enzymes that can catalyze the following reactions:

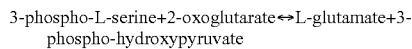
3-phospho-L-serine+2-oxoglutarate⇌L-glutamate+3-phospho-hydroxypyruvate

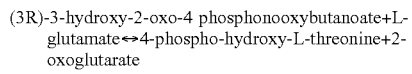
(3R)-3-hydroxy-2-oxo-4 phosphonooxybutanoate+L-glutamate⇌4-phospho-hydroxy-L-threonine+2-oxoglutarate

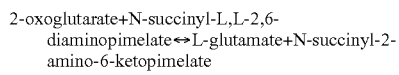
2-oxoglutarate+N-succinyl-L,L-2,6-diaminopimelate⇌L-glutamate+N-succinyl-2-amino-6-ketopimelate 3-phosphoserine aminotransferase may also be known as phosphoserine transaminase; PSAT; phosphoserine aminotransferase; hydroxypyruvic phosphate-glutamic transaminase; L-phosphoserine aminotransferase; phosphohydroxypyruvate transaminase; phosphohydroxypyruvic-glutamic transaminase; 3-O-phospho-L-serine:2-oxoglutarate aminotransferase; SerC; PdxC; 3PHP transaminase The serC-encoded enzyme, phosphoserine/phosphohydroxythreonine aminotransferase, functions in the biosynthesis of both serine and pyridoxine, by using different substrates. Pyridoxal 5'-phosphate is a cofactor for both enzyme activities, suggesting that it can act in an autocatalytic fashion, stimulating its own biosynthesis.

The redundancy and promiscuity among aminotransferase enzymes has been investigated. No activity could be observed with non-phosphorylated substrates; however, 3-hydroxypyruvate was able to be used as the substrate for an assay of SerC enzymatic activity. In addition, genetic experiments showed that SerC is a minor alanine transaminase.

The normal activities of two enzymes, ArgD and SerC, are sufficient for succinyldiaminopimelate (SDAP) and lysine biosynthesis; a third enzyme, AstC, is sufficient for SDAP biosynthesis, but alone can not fulfill the cell's requirement for lysine. Additional enzymes, including GabT and PuuE, may be able to contribute to SDAP biosynthesis. Expression of argD, astC, serC, aspC, gabT, hisC, ilvE, patA, puuE, or tyrB from a plasmid allows growth of the triple ΔargD serC astC mutant on minimal medium.

Crystal structures of the enzyme in the unligated form and in complex with the substrate analog α-methyl-L-glutamate have been solved, and a molecular reaction mechanism was proposed.

serC is essential for growth on glycerol minimal medium; the growth defect can be rescued by addition of serine and pyridoxol/pyridoxine.

In some embodiments, the enzyme having phosphoserine aminotransferase activity can be an enzyme having L-serine transaminase activity or an enzyme having serine aminotransferase activity. In some embodiments, an enzyme having phosphoserine aminotransferase activity, an enzyme having L-serine transaminase activity or an enzyme having serine aminotransferase activity catalyzes the conversion of L-serine to hydroxypyruvate. In some embodiments, the enzyme having phosphoserine aminotransferase activity, the enzyme having L-serine transaminase activity or the enzyme having serine aminotransferase activity is encoded by an amino acid sequence having at least 70% sequence identity, having at least 80% sequence identity, or having at least 90% sequence identity to serC. In some embodiments, the enzyme having phosphoserine aminotransferase activity, the enzyme having L-serine transaminase activity or the enzyme having serine aminotransferase activity is serC.

In some embodiments, the one or more nucleic acid molecules encoding the enzyme having phosphoserine aminotransferase activity is serC, or homolog thereof. In another embodiment, the one or more nucleic acid molecules encoding an enzyme having phosphoserine aminotransferase activity, an enzyme having L-serine transaminase activity, or an enzyme having serine aminotransferase activity comprise an amino acid sequence set forth in SEQ ID NO: 230. In a further embodiment, the one or more nucleic acid molecule encoding an enzyme having phosphoserine aminotransferase activity, an enzyme having L-serine transaminase activity or an enzyme having serine aminotransferase activity is encoded by a nucleic acid sequence set forth in SEQ ID NO: 229.

3-Phospho-Hydroxypyruvate Phosphatase

The present disclosure describes enzymes that can catalyze the following reaction:

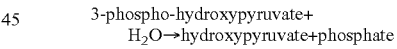
3-phospho-hydroxypyruvate+H$_2$O→hydroxypyruvate+phosphate

YeaB (NudL) belongs to the Nudix family of hydrolases and was predicted to have CoA pyrophosphohydrolase activity.

yeaB (nudL) was isolated as a multicopy suppressor of the repression of flhDC transcription in a pgsA mutant. The suppression may be due to the reduction of $\sigma^S$ expression in cells that overexpress nudL.

yeaB (nudL) was also isolated as a multicopy suppressor of the PLP auxotrophy of a pdxB deletion strain. NudL was found to be part of a serendipitous metabolic pathway that produces an intermediate of the pyridoxal 5'-phosphate biosynthesis I pathway, 4-phospho-hydroxy-L-threonine, that lies downstream of PdxB. The pathway diverts 3-phosphohydroxypyruvate from serine biosynthesis. With a $K_{cat}$ of $5.7 \times 10^{-5}$, NudL is an inefficient catalyst of the conversion of 3-phosphohydroxypyruvate to hydroxypyruvate, but its activity appears to be sufficient for production of PLP.

In some embodiments, the enzyme having 3-phospho-hydroxypyruvate phosphatase activity is encoded by an amino acid sequence having at least 70% sequence identity, having at least 80% sequence identity, or having at least 90% sequence identity to yeaB. In some embodiments, the enzyme having 3-phospho-hydroxypyruvate phosphatase activity is yeaB.

In some embodiments, the one or more nucleic acid molecules encoding the enzyme having 3-phospho-hydroxypyruvate phosphatase activity is yeaB, or homolog thereof. In another embodiment, the one or more nucleic acid molecules encoding an enzyme having 3-phospho-hydroxypyruvate phosphatase activity comprise an amino acid sequence set forth in SEQ ID NO: 232. In a further embodiment, the one or more nucleic acid molecule encoding an enzyme having 3-phospho-hydroxypyruvate phosphatase activity is encoded by a nucleic acid sequence set forth in SEQ ID NO: 231.

Phosphoserine Phosphatase (EC 3.1.3.3)

The present disclosure describes enzymes that can catalyze the following reaction:

3-phospho-L-serine+$H_2O$→L-serine+phosphate

Phosphoserine phosphatase catalyzes the last step in serine biosynthesis. The enzyme belongs to the superfamily of haloacid dehalogenase (HAD)-like hydrolases. Enzymatic studies were originally performed using partially purified enzyme from *E. coli* strain W; assays of the purified enzyme were performed as part of an investigation of the HAD superfamily of enzymes.

serB is essential for growth on glycerol minimal medium; the growth defect can be rescued by addition of serine. Gph, HisB and YtjC were identified as multicopy suppressors of the conditional ΔserB phenotype. Directed evolution experiments identified mutations that increased fitness and enzymatic activity of these suppressors.

In some embodiments, the enzyme having phosphoserine phosphatase activity is encoded by an amino acid sequence having at least 70% sequence identity, having at least 80% sequence identity, or having at least 90% sequence identity to serB. In some embodiments, the enzyme having phosphoserine phosphatase activity is serB.

In some embodiments, the one or more nucleic acid molecules encoding the enzyme having phosphoserine phosphatase activity is serB, or homolog thereof. In another embodiment, the one or more nucleic acid molecules encoding an enzyme having phosphoserine phosphatase activity comprise an amino acid sequence set forth in SEQ ID NO: 234. In a further embodiment, the one or more nucleic acid molecule encoding an enzyme having phosphoserine phosphatase activity is encoded by a nucleic acid sequence set forth in SEQ ID NO: 233.

Serine-Pyruvate Aminotransferase (EC 2.6.1.51)

The present disclosure describes enzymes that can catalyze the following reactions:

pyruvate+L-serine⇌L-alanine+hydroxypyruvate

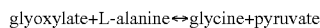

glyoxylate+L-alanine⇌glycine+pyruvate

Serine-pyruvate aminotransferase may also be known as alanine-glyoxylate aminotransferase.

The peroxisomal serine-pyruvate aminotransferase (AGXT1) and mitochondrially localized alanine-glyoxylate aminotransferase 2 (AGXT2) both catalyze the conversion of glyoxylate to glycine using alanine as the amino donor. Unlike AGXT2, AGXT1 cannot utilize asymmetric dimethylarginine (ADMA) as an amino donor.

Peroxisomal serine-pyruvate aminotransferase is a pyridoxal phosphate dependent liver specific enzyme composed of a homodimer. Its location in the peroxisome is crucial for proper enzyme activity. A peroxisomal targeting sequence (PTS1) at the C-terminus is required for translocation into peroxisomes.

Dysfunction or mistargeting of serine-pyruvate aminotransferase leading to absence in hepatic peroxisomes, causes glyoxylate to escape into the cytosol where it is further metabolized to oxalate and glycolate. Oxalate cannot be further metabolized in humans and leads to the formation of insoluble calcium oxalate in the kidney and urinary tract. Mutations in the AGXT1 gene leads to improper peroxisomal targeting and causes the autosomal recessive metabolic disorder, primary hyperoxaluria type 1, which results in irreversible kidney damage. One-third of primary hyperoxaluria type 1 patients have a unique protein sorting defect in which the hepatic peroxisomal enzyme is mistargeted to the mitochondria.

In some embodiments, the enzyme having serine-pyruvate aminotransferase activity is encoded by an amino acid sequence having at least 70% sequence identity, having at least 80% sequence identity, or having at least 90% sequence identity to *Homo sapiens* AGXT1. In some embodiments, the enzyme having serine-pyruvate aminotransferase activity is *Homo sapiens* AGXT1.

In some embodiments, the one or more nucleic acid molecules encoding the enzyme having serine-pyruvate aminotransferase activity is AGXT1, or homolog thereof. In some embodiments, the one or more nucleic acid molecules encoding an enzyme having serine-pyruvate aminotransferase activity comprise an amino acid sequence set forth in SEQ ID NO: 244. In a further embodiment, the one or more nucleic acid molecule encoding an enzyme having serine-pyruvate aminotranserase activity is encoded by a nucleic acid sequence set forth in SEQ ID NO: 243.

Serine Decarboxylase (EC 4.1.1.65)

The present disclosure describes enzymes that can catalyze the following reaction:

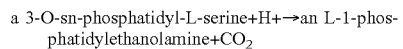

a 3-O-sn-phosphatidyl-L-serine+H+→an L-1-phosphatidylethanolamine+$CO_2$

Serine decarboxylase may also be known as phosphatidylserine decarboxylase; PS decarboxylase; phosphatidyl-L-serine carboxy-lyase.

Phosphatidylserine decarboxylase is one of a small class of enzymes that use a covalently bound pyruvoyl prosthetic group. The pyruvoyl group is thought to act analogously to pyridoxal phosphate cofactor by forming a Schiff base with the amino group of the substrate and then serving as an electron sink to facilitate the decarboxylation.

Four of these enzymes, histidine decarboxylase (E.C. 4.1.1.22), phosphatidylserine decarboxylase, aspartate 1-decarboxylase, and S-adenosylmethionine decarboxylase are decarboxylases forming important biological amines. All of these enzymes are known to have the pyruvoyl prosthetic group attached via an amide linkage to the amino terminus of the a subunit. Two other enzymes in this group are D-proline reductase and glycine reductase (E.C. 1.21.4.2).

Pyruvoyl-containing enzymes are expressed as a zymogen which is processed post-translationally by a self-maturation cleavage called serinolysis. In this process the pyruvoul group is formed from a serine residue, splitting the precursor protein into two parts which become the α and β subunits. In some cases additional subunits may be involved.

This enzyme differs from other pyruvoyl-dependent decarboxylases composed of nonidentical subunits in that the pyruvate prosthetic group is associated with the smaller subunit. The enzyme is a multimer of unknown number of the heterodimer.

In some embodiments, an enzyme having serine decarboxylase activity catalyzes the conversion of L-serine to ethanolamine.

In some embodiments, the enzyme having serine decarboxylase activity is encoded by an amino acid sequence having at least 70% sequence identity, having at least 80% sequence identity, or having at least 90% sequence identity to *Arabidopsis thaliana* SDC. In some embodiments, the enzyme having serine decarboxylase activity is *Arabidopsis thaliana* SDC.

In some embodiments, the one or more nucleic acid molecules encoding the enzyme having serine decarboxylase activity is SDC, or homolog thereof. In some embodiments, the one or more nucleic acid molecules encoding an enzyme having serine decarboxylase activity comprise an amino acid sequence set forth in SEQ ID NO: 236. In a further embodiment, the one or more nucleic acid molecule encoding an enzyme having serine decarboxylase activity is encoded by a nucleic acid sequence set forth in SEQ ID NO: 235.

Ethanolamine Oxidoreductase (Deaminating) (EC 1.4.3.8), Ethanolamine Aminotransferase (EC 2.6.1.-)

The present disclosure describes enzymes that can catalyze the following reactions:

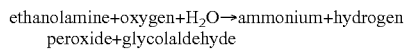

ethanolamine+oxygen+H$_2$O→ammonium+hydrogen peroxide+glycolaldehyde

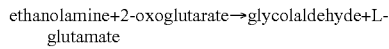

ethanolamine+2-oxoglutarate→glycolaldehyde+L-glutamate

Ethanolamine oxidoreductase (deaminating) may also be known as ethanolamine oxidase. This enzyme belongs to the family of oxidoreductases, specifically those acting on the CH—NH$_2$ group of donors with oxygen as acceptor.

In some embodiments, an ethanolamine oxidase or an ethanolamine aminotransferase catalyzes the conversion of ethanolamine to gylcolaldehyde.

In some embodiments, the enzyme having ethanolamine oxidase activity is encoded by an amino acid sequence having at least 70% sequence identity, having at least 80% sequence identity, or having at least 90% sequence identity to *E. coli* tynA. In some embodiments, the enzyme having ethanolamine oxidase activity is *E. coli* tynA.

In some embodiments, the one or more nucleic acid molecules encoding the enzyme having ethanolamine oxidase activity is tynA, or homolog thereof. In some embodiments, the one or more nucleic acid molecules encoding an enzyme having ethanolamine oxidase activity comprise an amino acid sequence set forth in SEQ ID NO: 238. In a further embodiment, the one or more nucleic acid molecule encoding an enzyme having ethanolamine oxidase activity is encoded by a nucleic acid sequence set forth in SEQ ID NO: 237.

In some embodiments, the enzyme having ethanolamine aminotransferase activity is encoded by an amino acid sequence having at least 70% sequence identity, having at least 80% sequence identity, or having at least 90% sequence identity to *E. coli* alaA. In some embodiments, the enzyme having ethanolamine aminotransferase activity is *E. coli* alaA.

In some embodiments, the one or more nucleic acid molecules encoding the enzyme having ethanolamine aminotransferase activity is alaA, or homolog thereof. In some embodiments, the one or more nucleic acid molecules encoding an enzyme having ethanolamine aminotransferase activity comprise an amino acid sequence set forth in SEQ ID NO: 240. In a further embodiment, the one or more nucleic acid molecule encoding an enzyme having ethanolamine aminotransferase activity is encoded by a nucleic acid sequence set forth in SEQ ID NOs: 239.

Hydroxypyruvate Reductase (EC 1.1.1.-)

The present disclosure describes enzymes that can catalyze the following reactions:

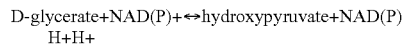

D-glycerate+NAD(P)+↔hydroxypyruvate+NAD(P)H+H+

Hydroxypyruvate reductase may also be known as beta-hydroxypyruvate reductase; NADH:hydroxypyruvate reductase; D-glycerate dehydrogenase.

Hydroxypyruvate reductase is an enzyme found in higher plants, algae, mammalian tissues and bacteria. In most cases it has been postulated to convert hydroxypyruvate to glycerate. However, most enzymes also carry the reduction of glyoxylate to glycolate.

In the serine cycle methylotrophs, hydroxypyruvate reductase plays a key role in the assimilation of carbon. It catalyzes the conversion of hydroxypyruvate to glycerate, a key step of the serine cycle, but it also plays an important role in the metabolism of C2 compounds, by interconverting glyoxylate and glycolate.

In some embodiments, hydroxypyruvate reductase catalyzes the conversion of glycerate to hydroxypyruvate.

In some embodiments, the enzyme having hydroxypyruvate reductase activity is encoded by an amino acid sequence having at least 70% sequence identity, having at least 80% sequence identity, or having at least 90% sequence identity to *E. coli* ghrB. In some embodiments, the enzyme having hydroxypyruvate reductase activity is *E. coli* ghrB.

In some embodiments, the one or more nucleic acid molecules encoding the hydroxypyruvate reductase is ghrB, or homolog thereof. In some embodiments, the one or more nucleic acid molecules encoding an enzyme having hydroxypyruvate reductase activity comprise an amino acid sequence set forth in SEQ ID NO: 242. In a further embodiment, the one or more nucleic acid molecule encoding an enzyme having hydroxypyruvate reductase activity is encoded by a nucleic acid sequence selected from the group consisting of SEQ ID NO: 241.

Glycerate Decarboxylase

The present disclosure describes enzymes that can catalyze the following reaction:

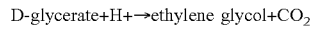

D-glycerate+H+→ethylene glycol+CO$_2$

In some embodiments, glycerate decarboxylase catalyzes the conversion of glycerate to ethylene glycol.

3-Phosphoglycerate Phosphatase (EC 3.1.3.38) or 2-Phosphoglycerate Phosphatase (EC 3.1.3.20)

The present disclosure describes enzymes that can catalyze the following reaction:

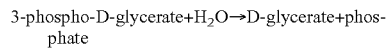

3-phospho-D-glycerate+H$_2$O→D-glycerate+phosphate

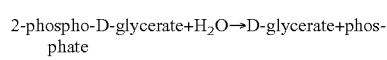

2-phospho-D-glycerate+H$_2$O→D-glycerate+phosphate 3-phosphoglycerate phosphatase may also be known as D-3-phosphoglycerate phosphatase; 3-PGA phosphatase. 2-phosphoglycerate phosphatase may also be known as D-2-phosphoglycerate phosphatase; 2-PGA phosphatase. These enzymes belong to the family of hydrolases, specifically those acting on phosphoric monoester bonds.

In some embodiments, the enzyme having 3-phosphoglycerate phosphatase activity or the enzyme having 2-phosphoglycerate phosphatase activity is encoded by an amino acid sequence having at least 70% sequence identity, having at least 80% sequence identity, or having at least 90% sequence identity to *E. coli* phoA. In some embodiments, the enzyme having 3-phosphoglycerate phosphatase activity or enzyme having 2-phosphoglycerate phosphatase activity is *E. coli* phoA.

In some embodiments, the one or more nucleic acid molecules encoding the enzyme having 3-phosphoglycerate phosphatase activity or enzyme having 2-phosphoglycerate phosphatase activity is phoA, or homolog thereof. In some embodiments, the one or more nucleic acid molecules encoding an enzyme having 3-phosphoglycerate phosphatase activity or enzyme having 2-phosphoglycerate phosphatase activity comprise an amino acid sequence set forth in SEQ ID NO: 246. In a further embodiment, the one or more nucleic acid molecule encoding an enzyme having 3-phosphoglycerate phosphatase activity or enzyme having 2-phosphoglycerate phosphatase activity is encoded by a nucleic acid sequence set forth in SEQ ID NO: 245.

Glycerate Kinase (EC 2.7.1.31)

The present disclosure describes enzymes that can catalyze the following reaction:

D-glycerate+ATP↔3-phospho-D-glycerate+ADP+H+

D-glycerate+ATP↔2-phospho-D-glycerate+ADP+H+

Glycerate kinase may also be known as glycerate 3-kinase; glycerate kinase (phosphorylating) (ambiguous); D-glycerate 3-kinase; D-glycerate kinase (ambiguous); glycerate-kinase (ambiguous); GK (ambiguous); D-glyceric acid kinase (ambiguous); ATP:(R)-glycerate 3-phosphotransferase.

This enzyme belongs to the family of transferases, specifically those transferring phosphorus-containing groups (phosphotransferases) with an alcohol group as acceptor. This enzyme participates in 3 metabolic pathways: serine/glycine/threonine metabolism, glycerolipid metabolism, and glyoxylate-dicarboxylate metabolism.

In some embodiments, an enzyme having glycerate kinase activity catalyzes the conversion of 3-phosphoglycerate to glycerate. In other embodiments, an enzyme having glycerate kinase activity catalyzes the conversion of 2-phosphoglycerate to glycerate.

In some embodiments, the enzyme having glycerate kinase activity is a glycerate 3-kinase. In some embodiments, the enzyme having glycerate 3-kinase activity is encoded by an amino acid sequence having at least 70% sequence identity, having at least 80% sequence identity, or having at least 90% sequence identity to *Arabidopsis thaliana* GLYK. In some embodiments, the glycerate 3-kinase is *Arabidopsis thaliana* GLYK.

In some embodiments, the one or more nucleic acid molecules encoding the enzyme having glycerate 3-kinase activity is GLYK, or homolog thereof. In some embodiments, the one or more nucleic acid molecules encoding an enzyme having glycerate 3-kinase activity comprise an amino acid sequence set forth in SEQ ID NO: 248. In a further embodiment, the one or more nucleic acid molecule encoding an enzyme having glycerate 3-kinase activity is encoded by a nucleic acid sequence set forth in SEQ ID NO: 247.

In some embodiments, the enzyme having glycerate kinase activity is an enzyme having glycerate 2-kinase activity. In some embodiments, the enzyme having glycerate 2-kinase activity is encoded by an amino acid sequence having at least 70% sequence identity, having at least 80% sequence identity, or having at least 90% sequence identity to *E. coli* glxK. In some embodiments, the enzyme having glycerate 2-kinase activity is encoded by an amino acid sequence having at least 70% sequence identity, having at least 80% sequence identity, or having at least 90% sequence identity to *E. coli* garK. In other embodiments, the enzyme having glycerate 2-kinase activity is *E. coli* glxK. In some embodiments, the glycerate 2-kinase is *E. coli* garK.

In some embodiments, the one or more nucleic acid molecules encoding the enzyme having glycerate 2-kinase activity is glxK, or homolog thereof. In some embodiments, the one or more nucleic acid molecules encoding the enzyme having glycerate 2-kinase activity is garK, or homolog thereof. In some embodiments, the one or more nucleic acid molecules encoding an enzyme having glycerate 2-kinase activity comprise an amino acid sequence selected from SEQ ID NOs: 250 and 252. In a further embodiment, the one or more nucleic acid molecule encoding an enzyme having glycerate 2-kinase activity is encoded by a nucleic acid sequence selected from SEQ ID NOs: 249 and 251.

Transferase that Transfers One-Carbon Group (EC 2.1.2.-)

The present disclosure describes enzymes that can catalyze the following reaction:

M-THF+H₂O↔THF+formaldehyde

Transferases such as the hydroxymethyl-, formyl- and related transferases may be used. Examples of hydroxymethyl-, formyl- and related transferases include glycine hydroxymethyltransferase, phosphoribosylglycinamide formyltransferase, phosphoribosylaminoimidazolecarboxamide formyltransferase, glycine formimidoyltransferase, glutamate formiminotransferase, D-alanine 2-hydroxymethyltransferase, deoxycytidylate 5-hydroxymethyltransferase, methionyl-tRNA formyltransferase, aminomethyltransferase, 3-methyl-2-oxobutanoate hydroxymethyltransferase and UDP-4-amino-4-deoxy-L-arabinose formyltransferase.

Serine Hydroxymethyltransferase (EC 2.1.2.1)

The present disclosure describes enzymes that can catalyze the following reaction:

L-serine+tetrahydrofolate (THF)↔Glycine+5,10-methylenetetrahydrofolate (M-THF)

Serine hydroxymethyltransferase (GlyA) converts serine to glycine, transferring a methyl group to tetrahydrofolate, thus forming 5,10-methylene-tetrahydrofolate (M-THF). M-THF is the major source of C1 units in the cell, making GlyA a key enzyme in the biosynthesis of purines, thymidine, methionine, choline and lipids.

The enzyme also catalyzes several side reactions including hydrolysis of 5,10-methenylTHF to 5-formylTHF and the reversible cleavage of 3-hydroxy amino acids (L-threonine, allothreonine, 3-phenylserine) to glycine and an aldehyde. D-alanine inactivates the enzyme by reacting with the pyridoxal phosphate prosthetic group to form pyridoxamine phosphate.

The Thr226 residue within a conserved region of the enzyme appears to be involved in substrate discrimination. The His228 residue plays a role in determining reaction specificity. Lys229 does not appear to play a catalytic role. Arg363 appears to be the binding site for the carboxyl group of the amino acid substrate. The hydroxyl group of Tyr65 may be involved in the conversion of the active site from a closed to an open conformation. Both Tyr55 and Arg235 are required for the transaldimination reaction.

Studies on refolding of the enzyme indicate that pyridoxal 5'-phosphate (PLP) only binds to the dimeric apoenzyme at the end of the folding pathway. The mechanism of PLP addition has been investigated further. At high concentrations of PLP, a second molecule of PLP can bind at Lys346.

A conserved hydrophobic contact area is involved in stability of the PLP binding site. Tyr55 is required for correct positioning of the PLP cofactor.

Crystal structures of wild type and mutant serine hydroxymethyltransferase have been solved.

glyA mutants cannot use glycine as the sole source of nitrogen. A glyA mutant is auxotrophic for glycine; glyA was later shown to be essential for growth on glycerol minimal medium.

Sequences 3' to the structural gene within the glyA mRNA are required for mRNA stability.

In some embodiments, the enzyme having serine hydroxymethyltransferase activity is encoded by an amino acid sequence having at least 70% sequence identity, having at least 80% sequence identity, or having at least 90% sequence identity to *E. coli* glyA. In some embodiments, the one or more nucleic acid molecule encoding an enzyme having serine hydroxymethyltransferase comprises an amino acid sequence set forth in UniProt ID P0A825. In a further embodiment, the one or more nucleic acid molecule encoding an enzyme having serine hydroxymethyltransferase is encoded by a nucleic acid sequence set forth in Gene ID 947022.

Formaldehyde Dehydrogenase (EC 1.2.1.46 and EC 1.2.1.-)

The present disclosure describes enzymes that can catalyze the following reaction:

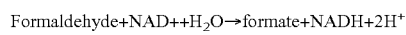

Formaldehyde+NAD++H$_2$O→formate+NADH+2H$^+$

Formaldehyde dehydrogenase may also be known as NAD-linked formaldehyde dehydrogenase, NAD-dependent formaldehyde dehydrogenase or formaldehyde:NAD$^+$ oxidoreductase.

Most of the formaldehyde dehydrogenases found in animals, plants and bacteria belong to a group called class III alcohol dehydrogenase group and require the addition of glutathione for activity. As a matter of fact, the true substrate for these enzymes was shown to be not formaldehyde, but S-hydroxymethylglutathione, which is formed nonenzymatically from formaldehyde and glutathione.

Unlike those enzymes, the enzyme isolated from *Pseudomonas putida* catalyzes the irreversible oxidation of formaldehyde to formate without the addition of glutathione. Since its substrate is formaldehyde, in an essence this is the "genuine" formaldehyde dehydrogenase. Like other formaldehyde dehydrogenases, the *P. putida* FDH is a zinc-containing metalloenzyme. It also requires NAD+ as the electron acceptor. However, unlike the enzymes that belong to the class III alcohol dehydrogenase group, it is sensitive to 4-methylpyrazole. In one embodiment, the formaldehyde dehydrogenase is from *Pseudomonas putida*. In some embodiments, the formaldehyde dehydrogenase is encoded by an amino acid sequence having at least 70% sequence identity, having at least 80% sequence identity, or having at least 90% sequence identity to *P. putida* fdhA. In some embodiments, the one or more nucleic acid molecule encoding a formaldehyde dehydrogenase comprises an amino acid sequence set forth in GenBank Accession BAA04743.1. In a further embodiment, the one or more nucleic acid molecule encoding a formaldehyde dehydrogenase is encoded by a nucleic acid sequence set forth in GenBank Accession D21201.1.

In the industrially important actinomycete *Corynebacterium glutamicum* ATCC 13032, evidence suggests that two enzymes contribute to the degradation of toxic formaldehyde, mycothiol-dependent formaldehyde dehydrogenase encoded by gene fadH, and to a lesser extent acetaldehyde dehydrogenase encoded by gene ald (acetaldehyde dehydrogenase). A mutant lacking both of these enzymes was unable to grow in formaldehyde-containing medium. It also did not grow in vanillate-containing medium because the oxidation of vanillate produces intracellular formaldehyde. Detoxification of formaldehyde is necessary when this soil bacterium encounters formaldehyde in its habitat, or when formaldehyde is generated during metabolism of environmental compounds such as vanillate. The formate produced by FadH can be further oxidized to CO$_2$ by the formate dehydrogenase encoded by gene fdhF.

An ald mutant showed a reduction in formaldehyde degradation of about 30% as compared with wild-type. Inactivation of the chromosomal ald gene resulted in loss of acetaldehyde dehydrogenase activity and loss of the ability of this organism to grow on or utilize ethanol, suggesting a two step oxidation of ethanol to acetate. Expression of gene ald is dependent on the transcriptional regulator RamA, whereas RamB has a slightly negative effect on expression. In one embodiment, the formaldehyde dehydrogenase is from *Corynebacterium glutamicum* ATCC 13032. In some embodiments, the formaldehyde dehydrogenase is encoded by an amino acid sequence having at least 70% sequence identity, having at least 80% sequence identity, or having at least 90% sequence identity to *Corynebacterium glutamicum* ATCC 13032 ald. In some embodiments, the one or more nucleic acid molecule encoding a formaldehyde dehydrogenase comprises an amino acid sequence set forth in UniProt ID Q8NLZ0. In a further embodiment, the one or more nucleic acid molecule encoding a formaldehyde dehydrogenase is encoded by a nucleic acid sequence set forth in Gene ID 1020739.

In some embodiments, the formaldehyde dehydrogenase is encoded by an amino acid sequence having at least 70% sequence identity, having at least 80% sequence identity, or having at least 90% sequence identity to *Pseudomonas oleovorans* alkH.

In *Saccharomyces cerevisiae*, two tandem-repeated genes ALD2 and ALD3 encode two cytoplasmic stress-inducible isoforms of aldehyde dehydrogenase. The expression of these isoforms is dependent on the general-stress transcription factors Msn2 and Msn4 but is independent of the HOG MAP kinase pathway. Both forms can use the cofactor NAD+ much more efficiently that NADP+, and are not activated by any cations. While ALD3 is induced by a variety of stresses, including osmotic shock, heat shock, glucose exhaustion, oxidative stress and drugs, ALD2 is only induced by osmotic stress and glucose exhaustion.

In some embodiments, the formaldehyde dehydrogenase is encoded by an amino acid sequence having at least 70% sequence identity, having at least 80% sequence identity, or having at least 90% sequence identity to *Saccharomyces cerevisiae* ALD2. In other embodiments, the formaldehyde dehydrogenase is encoded by an amino acid sequence having at least 70% sequence identity, having at least 80% sequence identity, or having at least 90% sequence identity to *Saccharomyces cerevisiae* ALD3. In some embodiments, the one or more nucleic acid molecule encoding a formaldehyde dehydrogenase comprises an amino acid sequence selected from UniProt ID P47771 and UniProt ID P54114. In a further embodiment, the one or more nucleic acid molecule encoding a formaldehyde dehydrogenase is encoded by a nucleic acid sequence selected from Gene ID 855206 and Gene ID 855205.

In some embodiments, the enzyme having formaldehyde dehydrogenase activity is encoded by an amino acid sequence having at least 70% sequence identity, having at least 80% sequence identity, or having at least 90% sequence identity to *Homo sapiens* ALDH3A2. In other embodiments, the enzyme having formaldehyde dehydrogenase activity is encoded by an amino acid sequence having at least 70% sequence identity, having at least 80% sequence identity, or having at least 90% sequence identity to *Homo sapiens* ALDH9A1. In some embodiments, the one or more nucleic acid molecule encoding an enzyme having formaldehyde dehydrogenase activity comprises an amino acid sequence selected from UniProt ID P51648 and UniProt ID P49189. In a further embodiment, the one or more nucleic acid molecule encoding an enzyme having formaldehyde dehydrogenase activity is encoded by a nucleic acid sequence selected from Gene ID 224 and Gene ID 223.

Formate Dehydrogenase (EC 1.2.1.-)

The present disclosure describes enzymes that can catalyze the following reactions:

formate+an oxidized electron acceptor+H+→$CO_2$+a reduced electron acceptor formate+H+→$CO_2$+$H_2$(catalyzed by complex)

formate+an oxidized hydrogenase 3→$CO_2$+a reduced hydrogenase 3

Formate dehydrogenase-H is one of three membrane-associated formate dehydrogenase isoenzymes in *E. coli*. All are functional in the anaerobic metabolism of the organism.

Formate dehydrogenase-H (FDH-H) is located in the cytoplasm and together with hydrogenase-3, FDH-H forms the formate-hydrogen lyase complex. The enzyme is oxygen sensitive and contains selenium as selenocysteine incorporated cotranslationally at the position of an in-frame UGA stop codon in the FdhF open reading frame. A crystal structure of FDH-H has been solved at 2.3 Å resolution, confirming the presence of a [4Fe-4S] cluster, coordination of the Mo cofactor by selenocysteine, and the position of the binding site for the inhibitor nitrate. Expression of fdhF is induced by formate and the absence of external electron acceptors, and is repressed by nitrate, nitrite, trimethylamine N-oxide, and oxygen. Formate can overcome repression by nitrate but not by oxygen. Inhibition of DNA gyrase enhances expression of fdhF.

fdnGHI encodes membrane bound formate dehydrogenase N (FDH-N)—a respiratory enzyme that catalyses the oxidation of formate to carbon dioxide, donating electrons to the quinone pool for the reduction of anaerobic respiratory substrates such as nitrate and trimethylamine N-oxide. FDH-N is a member of the complex iron sulfur molybdoenzyme (CISM) family. The oxidation of formate by FDH-N is electrogenic (H+/e-=1); oxidation of formate in the periplasm is accompanied by menaquinone reduction at the cytoplasmic face of the inner membrane. Expression of formate dehydrogenase-N is induced by nitrate and anaerobiosis, mediated by NarL and Fnr, respectively. Purified FDH-N contains three subunits, designated α (FdnG), β (FdnH) and γ (FdnI). A crystal structure, resolved at 1.6 Å, indicates that this subcomplex is further organised into physiologically relevant trimers with the α and β subunits located towards the periplasmic face of the inner membrane and the γ subunits located towards the cytoplasm. Electrons are transferred from the site of formate oxidation in the a subunit across the membrane to the site of menaquinone reduction in the γ subunit. Protons are taken up from the cytoplasm at the menaquinone reduction site.

fdoGHI encodes formate dehydrogenase O (FDH-O)—a respiratory molybdoenzyme that catalyses the oxidation of formate to carbon dioxide, donating electrons to the membrane soluble quinone pool for the reduction of nitrate. FDH-O and nitrate reductase Z participate in a formate to nitrate electron transport pathway that is active when cells are shifted from aerobic to anaerobic conditions. The pathway operates with either menaquinone or ubiquinone. FDH-O appears to be expressed constitutively; unlike formate dehydrogenase N (FDH-N), it is not regulated by Fnr or NarL. Expression of FDH-O is increased under aerobic conditions; under anaerobic conditions, nitrate stimulates expression slightly; the global regulators H-NS and CRP may play a role in regulation of FDH-O expression. FDH-O may contribute to the cells ability to rapidly adapt to anaerobiosis while levels of FDH-N are still insufficient. FDH-O is a heterotrimeric complex consisting of an α (FdoG), a β (FdoH) and a γ (FdoI) subunit—it shares extensive sequence similarity and immunological properties with the anaerobically expressed FDH-N.

*Candida boidinii* formate dehydrogenase FDH1 is an NAD-dependent enzyme that mediates the detoxification of formate and is strongly inhibited by $Cu^{2+}$, Hg, p-chloromercuribenzoate, cyanide, azide, thiocyanate and cyanate. The inhibition of cyanide is reversible and competes with formate. Protein expression is induced by methanol and repressed by glucose. Since the enzymatic reaction catalyzed by this formate dehydrogenase can regenerate NADH, it has been cloned into *E. coli* to optimize NADH requiring engineered pathways.

In the industrially important actinomycete *Corynebacterium glutamicum* ATCC 13032 evidence suggests that a formate dehydrogenase catalyzes the oxidation of formate to $CO_2$. Both formate and toxic formaldehyde are present in the environment and can be dissimilated by this soil bacterium via the oxidation of formaldehyde to formate. This can be accomplished via FadH and Ald. Formate is then converted to $CO_2$ by FdhF. FdhF is a molybdenum cofactor-dependent formate dehydrogenase that is active under oxic conditions, and was speculated to be involved in the stress response. The exact electron acceptor used by FdhF has not been defined. Gene fdhF is part of a gene cluster containing related genes fdhD and cg0617 that were shown by mutant analysis to be required for formate dehydrogenase activity. The growth of *Corynebacterium glutamicum* ATCC 13032 is inhibited to some extent in the presence of formate and strains lacking formate dehydrogenase activity show increased inhibition. Radiotracer experiments showed that when *Corynebacterium glutamicum* ATCC 13032 was grown with glucose and $^{13}$C-formate, it was metabolized to $^{13}$C-carbon dioxide. An fdhF deletion mutant could not metabolize formate. Growth studies also demonstrated the requirement for $Mo^{2+}$. Protein sequence analysis suggested that FdhF is not an integral membrane protein, but is likely either cytosolic or membrane-associated. Putative orthologs have been identified in a variety of other soil bacteria.

When *Cupriavidus oxalaticus* is grown on formate as the main carbon and energy source, NAD+-dependent formate dehydrogenase is the key enzyme that generates NADH and $CO_2$. The latter enters the ribulose diphosphate carboxylase reaction. The enzyme has been purified to homogeneity from cells grown with formate. The enzyme is a complex flavoprotein containing 2 FMN (flavin mononucleotide), 18-25 non-heme iron atoms and 15-20 acid-labile sulfides. The specific activity was 42 units/mg. The enzyme is specific toward its natural substrate formate, but can accept multiple nonphysiological electron acceptors, including methylviologen, phenazine methosulfate, methylene blue, nitro blue tetrazolium salt, FMN, FAD, riboflavin, and oxygen. It has been shown that the enzyme can also catalyze the reaction in the opposite direction. However, under the conditions employed the enzyme catalyzed the oxidation of formate about 30 times faster than $CO_2$ reduction.

NAD+-dependent formate dehydrogenase from *Gottschalkia acidurici* catalyzes a reversible reaction. While it catalyzes the oxidation of formate to $CO_2$, it also catalyzes the reduction of the latter to formate, which is then converted to acetate. The enzyme has been partially purified and found to be a large enzyme complex (molecular weight of at least 200 kDa) that is very sensitive to oxygen and light. The enzyme contains a L-selenocysteine. Crude preparations of the enzyme could be coupled to NAD reduction during formate oxidation through ferredoxin. When the artificial electron acceptor methyl viologen was used instead of NAD, ferredoxin was not required. Cyanide inhibited the enzyme 90%. Basal formate oxidation activity in cell extracts was 0.85 μmol/min/mg protein, but increased 12-fold upon the addition of tungstate and selenite. Interestingly, the enzyme from the related organism *Clostridium cylindrosporum*, while having a similar requirement for selenite, requires molybdate rather than tungstate, which has an antagonistic effect on it.

The tungsten-containing NAD+-dependent formate dehydrogenase from *Methylobacterium extorquens* is a heterodimer containing iron-sulfur clusters, FMN and tungsten. It is somewhat unusual to find a tungsten-containing enzyme in aerobic bacteria, although several other examples have been found. The smaller β subunit appears to be a fusion protein, with its N-terminal domain related to NueE-like subunits, and its C-terminal domain related to NuoF-like subunits of known NADH-ubiquinone oxidoreductases.

Two different forms of formate dehydrogenase FDH have been purified from *Methylosinus trichosporium* OB3b independently by two groups, and the two proteins were found to have different properties. This protein is composed of two types of subunits in an apparent $\alpha_2\beta_2$ arrangement, with a total size of 315 kDa. It contains nonheme iron and sulfide, and no other metals, and appeared to require FMN.

The *Moraxella* sp. NAD+-dependent formate dehydrogenase fdh is a relatively simple dimeric protein, with no prosthetic groups.

In some embodiments, the enzyme having formate dehydrogenase activity is encoded by an amino acid sequence having at least 70% sequence identity, having at least 80% sequence identity, or having at least 90% sequence identity to a formate dehydrogenase selected from the group consisting of *E. coli* fdhF (chlF, FDH-H), *E. coli* FDH-N, *E. coli* FDH-O, *Candida boidinii* FDH1, *Corynebacterium glutamicum* fdhF, *Cupriavidus oxalaticus* NAD+-dependent formate dehydrogenase, *Gottschalkia acidurici* NAD+-dependent formate dehydrogenase, *Methylobacterium extorquens* Fdh1, *Methylosinus trichosporium* formate dehydrogenase, and *Moraxella* sp. NAD+-dependent formate dehydrogenase fdh. In some embodiments, the one or more nucleic acid molecule encoding a formate dehydrogenase or formate dehydrogenase subunit comprises an amino acid sequence selected from UniProt ID P07658, UniProt ID P0AEK7, UniProt ID P0AAJ3, UniProt ID P24183, UniProt ID P32176, UniProt ID P0AAJ5, UniProt ID P0AEL0, UniProt ID O13437, UniProt ID Q8NSY6, UniProt ID Q8KT17, UniProt ID Q8KT18, and UniProt ID O08375. In a further embodiment, the one or more nucleic acid molecule encoding a formate dehydrogenase or formate dehydrogenase subunit is encoded by a nucleic acid sequence selected from Gene ID 948584, Gene ID 946038, Gene ID 948794, Gene ID 946035, Gene ID 948394, Gene ID 948395, Gene ID 948383, GenBank accession AJ011046.2, Gene ID 1021531, GenBank accession AF489516, and GenBank accession Y13245.1.

Glycine Cleavage System

The glycine cleavage system is composed of four proteins: three enzymes and a carrier protein. In animals, the system is loosely bound to the mitochondrial inner membrane. The enzymes are i) P-protein (a pyridoxal phosphate-containing protein) or glycine dehydrogenase (decarboxylating) (EC1.4.4.2), ii) T-protein or aminomethyl-transferase (EC2.1.2.10), and iii) L-protein or dihydrolipoamide dehydrogenase (EC1.8.1.4). The carrier protein is called H-protein (a lipoic acid-containing protein).

The glycine cleavage reaction catalyzes the following reversible reaction:

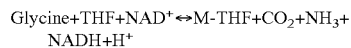

Glycine+THF+NAD$^+$↔M-THF+$CO_2$+NH$_3$+NADH+H$^+$

The system is partitioned into three partial reactions. The reaction is completely reversible, and in both glycine cleavage and glycine synthesis an aminomethyl moiety bound to the lipoic acid of H-protein represents an intermediate that is subsequently degraded to, or can be formed from, methylene-tetrahydrofolate (M-THF) and ammonia by the action of T-protein. Possibly the reaction may involve a ternary complex of P-protein, aminomethyl moiety of glycine and H-protein, as a crucial intermediary state.

Reaction Catalyzed by P-Protein

The first partial reaction of the glycine degradation is the decarboxylation catalyzed by P-protein (a glycine decarboxylase). H-protein serves as a co-substrate. One of the most characteristic properties of the glycine cleavage reaction is that, although P-protein should belong to a class of pyridoxal phosphate-dependent amino acid decarboxylases, P-protein requires H-protein to catalyze the decarboxylation of glycine significantly. The reaction proceeds via a sequential random mechanism where the carboxyl carbon of glycine is converted to carbon dioxide. The remnant of the glycine molecule is transferred to one of the sulfhydryl groups formed by the reductive cleavage of disulfide in lipoate attached to H-protein.

P-protein, a pyridoxal phosphate-containing protein of about 200 kDa, is either a homodimer or a dimer of heterodimers. The former has one molecule of pyridoxal phosphate per subunit, and the latter has one molecule of the cofactor per dimer on the β subunit. The pyridoxal cofactor is attached to a specific lysine residue. The pyridoxal cofactor interacts with the active-site pocket noncovalently. The active site of *T. thermophilus* P-protein is connected to the molecular surface by a channel with a broad entrance facing the solvent. The molecular surface around the channel is composed of several positively-charged amino acid residues, which are possibly involved in the complex formation with H-protein.

In some embodiments, the enzyme having glycine decarboxylase activity is encoded by an amino acid sequence having at least 70% sequence identity, having at least 80% sequence identity, or having at least 90% sequence identity to *E. coli* gcvP. In some embodiments, the one or more nucleic acid molecule encoding an enzyme having glycine decarboxylase activity comprises an amino acid sequence set forth in UniProt ID P33195. In a further embodiment, the one or more nucleic acid molecule encoding an enzyme having glycine decarboxylase activity is encoded by a nucleic acid sequence set forth in Gene ID 947394.

Reaction Catalyzed by T-Protein

The decarboxylated moiety of glycine attached to H-protein is subjected to further degradation catalyzed by T-protein (an aminomethyltransferase). The reaction requires THF and yields ammonia, M-THF, and H-protein with reduced lipoate. In the absence of THF, formaldehyde is produced instead of M-THF, but the reaction rate is less than 0.05% of that measured in the presence of THF. In the reverse reaction, T-protein catalyzes the formation of the H-protein-bound aminomethyl lipoate intermediate from M-THF, ammonia, and H-protein with reduced lipoate via an ordered Ter Bi mechanism, in which H-protein is the first substrate to bind followed by M-THF and ammonia. The order of the product release is THF and the methylamine-loaded H-protein.

T-protein is a monomer of about 40 kDa and forms a 1:1 complex with H-protein. A cross-linking study employing E. coli proteins revealed that the interaction of H-protein with T-protein causes a conformational change of T-protein. Intermolecular contact between Lys-288 of T-protein and Asp-43 of H-protein was found. The N-terminal region of T-protein is essential for the interaction with H-protein and for holding T-protein in a compact form. The crystal structure of human T-protein has been analyzed in a free form and that bound to N5-methyl-tetrahydrofolate, an analogue of M-THF. The overall structure consists of three cloverleaf-like structure with the central cavity where the THF cofactor is bound with the pteridin ring deeply buried into the hydrophobic pocket and the glutamyl group pointed to the C-terminal side surface. The structure resembles those of bacterial T-protein from *Termotoga naritima, E. coli*, and *Pyrococcus horikoshii* OT3. Structural and mutational analyses of human T-protein indicated that the invariant Asp-101 might play a key role in the initiation of the catalysis by increasing the nucleophilic character of the N10 atom of the folate substrate.

Residues involved in binding of folate have been identified by crosslinking and site-directed mutagenesis. The N-terminal region of GvcT is important for the proper conformation of GvcT, allowing interaction with the H-protein.

In some embodiments, the enzyme having aminomethyltransferase activity is encoded by an amino acid sequence having at least 70% sequence identity, having at least 80% sequence identity, or having at least 90% sequence identity to *E. coli* gcvT. In some embodiments, the one or more nucleic acid molecule encoding an enzyme having aminomethyltransferase activity comprises an amino acid sequence set forth in UniProt ID P27248. In a further embodiment, the one or more nucleic acid molecule encoding an enzyme having aminomethyltransferase activity is encoded by a nucleic acid sequence set forth in Gene ID 947390.

Reaction Catalyzed by L-Protein

The last step of the glycine cleavage reaction is the reoxidation of the reduced lipoate attached to H-protein catalyzed by L-protein. L-protein is well known as dihydrolipoamide dehydrogenase, lipoamide dehydrogenase, dihydrolipoyl dehydrogenase, or E3 protein component of 2-oxoacid (pyruvate, 2-oxoglutarate, and branched-chain 2-oxoacid) dehydrogenase multienzyme complexes. It catalyzes the transfer of electrons to the ultimate acceptor, NAD.

Experiments employing pea L-protein and H-protein showed that the oxidation of dihydrolipoyl H-protein was not affected by the presence of structurally related analogues such as apoH-protein or octanoylated H-protein. The structural interaction between L-protein and H-protein may not be essential for the oxidation reaction.

Kinetics of the reaction have been studied and suggest a modified ping-pong mechanism. Site-directed mutagenesis was used to identify and characterize the redox-active disulfide and a charged residue influencing the redox potential of the FAD cofactor. The insertion of the FAD cofactor is essential for dimerization and full activity.

An lpd null mutant produces more pyruvate and L-glutamate under aerobic conditions. Metabolic flux analysis shows that the Entner-Doudoroff pathway I and the glyoxylate shunt are activated. Another dihydrolipoate dehydrogenase activity has been detected in *E. coli* lpd mutants; thus, an isozyme may exist.

A mutation in the lpd gene in *E. coli* causes the pyruvate dehydrogenase complex to be less sensitive to NADH inhibition and active during anaerobic growth. Amino acid substitutions at Glu354 that lowered the sensitivity of the enzyme to NADH inhibition were proposed to act by restricting the movement of NADH.

Suppressor mutations in lpd have been shown to restore growth to a redox-defective mutant that lacks both the thioredoxin and glutathione/glutaredoxin reduction pathways. The suppressor mutations reduced Lpd activity resulting in dihydrolipoamide accumulation, which could then serve as an electron donor via reduction of glutaredoxins. The reoxidation of Lpd restored TCA cycle function.

lpd shows differential codon adaptation, resulting in differential translation efficiency signatures, in aerotolerant compared to obligate anaerobic microbes. It was therefore predicted to play a role in the oxidative stress response. An lpd deletion mutant was shown to be more sensitive than wild-type specifically to hydrogen peroxide exposure, but not other stresses.

In some embodiments, the enzyme having dihydrolipoamide dehydrogenase activity is encoded by an amino acid sequence having at least 70% sequence identity, having at least 80% sequence identity, or having at least 90% sequence identity to *E. coli* lpd (lpdA, E3 subunit). In some embodiments, the one or more nucleic acid molecule encoding an enzyme having dihydrolipoamide dehydrogenase activity comprises an amino acid sequence set forth in UniProt ID P0A9P0. In a further embodiment, the one or more nucleic acid molecule encoding an enzyme having dihydrolipoamide dehydrogenase activity is encoded by a nucleic acid sequence set forth in Gene ID 944854.

H-Protein

H-protein is a monomeric and heat-stable protein of about 14 kDa. Vertebrate H-protein is composed of 125 amino acid residues, and lipoic acid is covalently linked to Lys-59. The X-ray crystal structure of the lipoylated pea leaf H-protein (131 residues) revealed that the lipoyl-lysine was localized on the surface of the protein. As mentioned above, the lipoyllysine arm on H-protein shuttles the reaction intermediate and reducing equivalents between the active sites of the components of the glycine cleavage system. The mechanism is analogous to that found in 2-oxoacid dehydrogenase complexes.

Lipoylation of H-protein as well as acyltransferase (E2) components of 2-oxoacid dehydrogenase complexes is catalyzed by lipoate-protein ligase A (LplA) in *E. coli*. The enzyme catalyzes both the formation of lipoyl-AMP from lipoate and ATP and the transfer of the lipoyl-moiety of lipoyl-AMP to H-protein and E2 components. The X-ray crystallographic study showed that LplA consists of a large N-terminal domain and a small C-terminal domain with a substrate-binding pocket at the interface between the two domains.

In mammals, lipoylation is an intramitocondrial event. Lipoic acid is first activated to lipoyl-GMP by lipoate activating enzyme, employing GTP as a high-energy compound. Lipoate activating enzyme is the same protein already known as xenobiotic-metabolizing medium-chain fatty acid: CoA ligase-III. Lipoate is then transferred from lipoyl-GMP to apoproteins by the action of lipoyltransferase.

The H-protein, coded for by the gcvH gene in *E. coli*, is a lipoylprotein that is reduced as it shuttles the methylamine group of glycine from the P-protein to the T-protein and is reoxidized by the dihydrolipoamide dehydrogenase. GcvH functions as a substrate for the three enzymes of the gcv complex.

Residues 61-65 are predicted to contain the lipoyl modification (on lysine), based on conservation of these residues and their correspondence to the lipoate attachment site of the *Pisum sativum* protein.

The interaction between GcvH and GcvT has been examined. Interaction between the two proteins may be necessary to form the folate binding site, in which the folate polyglutamyl region binds, exposing the pteridine ring. The GcvT N terminus is important for interaction with GcvH, probably by mediating a conformational change, and residue D43 of GcvH is proximal to GcvT in the GcvH-GcvT complex.

In some embodiments, the H-protein is encoded by an amino acid sequence having at least 70% sequence identity, having at least 80% sequence identity, or having at least 90% sequence identity to *E. coli* gcvH. In some embodiments, the one or more nucleic acid molecule encoding an H-protein comprises an amino acid sequence set forth in UniProt ID P0A6T9. In a further embodiment, the one or more nucleic acid molecule encoding an H-protein is encoded by a nucleic acid sequence set forth in Gene ID 947393.

Glycolate Dehydrogenase or Glycolate Oxidase (EC 1.1.99.14)

The present disclosure describes enzymes that can catalyze the following reaction:

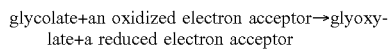

glycolate+an oxidized electron acceptor→glyoxylate+a reduced electron acceptor

Glycolate dehydrogenase may also be known as glycolate oxidase, glycolate oxidoreductase and glycolate:(acceptor) 2-oxidoreductase.

Glycolate oxidase catalyzes the first step in the utilization of glycolate as the sole source of carbon. The enzyme may be membrane-associated. A cytoplasmic membrane-associated glycolate oxidoreductase activity from *E. coli* ATCC11775 (serovar O1:K1:H7) has been isolated, and the GlcF subunit itself could only be detected in the membrane fraction. The physiological electron acceptor is unknown. Crude extracts from an *E. coli* strain expressing glcDEF from a multicopy plasmid contain glycolate oxidase activity. Insertion mutants in either glcD, glcE, or glcF abolish this activity, suggesting that all three gene products are subunits of a glycolate oxidase complex. Expression of the glcDEFGB operon is induced by growth on glycolate.

A putative glycolate oxidase in *Arabidopsis thaliana* is a mitochondrial homodimeric protein that binds one FAD per monomer and is expressed in leaves, stems, flowers and roots. Enzyme activity is inhibited by cyanide ions. It catalyzes the oxidation of D-lactate to pyruvate stereospecifically, mediating the detoxification of methylglyoxal and D-lactate.

In some embodiments, the enzyme having glycolate dehydrogenase activity is encoded by an amino acid sequence having at least 70% sequence identity, having at least 80% sequence identity, or having at least 90% sequence identity to an enzyme having glycolate dehydrogenase activity selected from *E. coli* glycolate dehydrogenase GLC and *Arabidopsis thaliana* glycolate dehydrogenase. In some embodiments, the one or more nucleic acid molecule encoding a glycolate dehydrogenase or glycolate dehydrogenase subunit comprises an amino acid sequence selected from UniProt ID P0AEP9, UniProt ID P52073, UniProt ID P52074, and UniProt ID Q94AX4. In a further embodiment, the one or more nucleic acid molecule encoding a glycolate dehydrogenase or glycolate dehydrogenase subunit is encoded by a nucleic acid sequence selected from Gene ID 947353, Gene ID 2847718, Gene ID 2847717, and GenBank accession Y13245.1.

Alanine-Glyoxylate Aminotransferase (EC 2.6.1.44)

The present disclosure describes enzymes that can catalyze the following reaction:

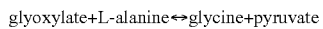

glyoxylate+L-alanine↔glycine+pyruvate

In *Saccharomyces cerevisiae* alanine-glyoxylate aminotransferase subunit is one of three different enzymes used for glycine synthesis. The AGX1 gene, encoding this enzyme, was identified by comparing enzyme specific activities in knockout strains. When placed in a background deficient for the other enzymes responsible for glycine synthesis, the mutation in AGX1 produced complete glycine auxotrophy. The enzymes was subsequently purified and characterized. The enzyme, which contains pyridoxal 5'-phosphate as cofactor, is a homodimer of about 80 kDa, and is highly specific for L-alanine and glyoxylate.

The mitochondrially localized *Homo sapiens* alanine-glyoxylate aminotransferase 2 (AGXT2) and peroxisomal serine-pyruvate aminotransferase (AGXT1, see above) both catalyze the conversion of glyoxylate to glycine using alanine as the amino donor. However, AGXT2, but not AGXT1, can also utilize asymmetric dimethylarginine (ADMA) as an amino donor, leading to the formation of α-keto-δ-(NN-dimethylguanidino) valeric acid (DMGV). ADMA is a potent endogenous inhibitor of nitric-oxide (NO) synthase. ADMA levels are also controlled by cytosolic dimethylarginine dimethylaminohydrolases (DDAHs) that hydrolyze ADMA to citrulline and dimethylamine. Elevated levels of ADMA are associated with diabetes, hypertension, congestive heart failure, and atherosclerosis. AGXT2 is a pyridoxal phosphate dependent enzyme that is expressed primarily in the kidney, and its activity is one mechanism by which the kidney regulates blood pressure.

In *Arabidopsis thaliana*, alanine transaminases with four aminotransferase activities have been identified. AOAT1 (GGAT1) is peroxisomal located. Knock-out plants have reduced activity of AOAT, GPAT (glutamate:pyruvate aminotransferase), AGAT (alanine:glyoxylate aminotransferase) and GGAT (glutamate:glyoxylate aminotransferase). The GGAT and AGAT activities were reduced most drastically. These indicate AOAT1 is primarily involved in photorespiration. Similary, AOAT2 (GGAT2), which is predicted to be located in the peroxisome, is likely involved in photorespiration. In vitro assay of the recombinant proteins indicated that GGAT1 and GGAT2 have four aminotransferase activities, namely GGAT, AGAT, GPAT and AOAT. The two recombinant proteins exhibited very similar Km values towards amino acid substrates glutamate and alanine, as well as the oxoacid substrates glyoxylate, pyruvate and 2-oxoglutarate.

In some embodiments, the enzyme having alanine-glyoxylate aminotransferase activity is encoded by an amino acid sequence having at least 70% sequence identity, having at least 80% sequence identity, or having at least 90% sequence identity to an enzyme having alanine-glyoxylate aminotransferase activity selected from *Saccharomyces cerevisiae* AGX1, *Homo sapiens* AGXT2, *Arabidopsis thaliana* AOAT1 and *Arabidopsis thaliana* AOAT2. In some embodiments, the one or more nucleic acid molecule encoding an enzyme having alanine-glyoxylate aminotransferase activity comprises an amino acid sequence selected from UniProt ID P43567, UniProt ID Q9BYV1, UniProt ID Q9LR30 and UniProt ID Q9S7E9. In a further embodiment, the one or more nucleic acid molecule encoding an enzyme having alanine-glyoxylate aminotransferase activity is encoded by a nucleic acid sequence selected from Gene ID 850514, Gene ID 64902, TAIR accession AT1G23310 and TAIR accession AT1G70580.

Alanine Transaminase (EC 2.6.1.2)

The present disclosure describes enzymes that can catalyze the following reaction:

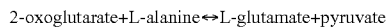

2-oxoglutarate+L-alanine↔L-glutamate+pyruvate

In some embodiments, the alanine transaminase is a glutamate-pyruvate aminotransferase. AlaA is one of three major alanine-synthesizing transaminases in *E. coli*. AlaA and AlaC together account for 90% of glutamic-pyruvic transaminase (GPT) activity in the cell. A crystal structure of AlaA has been solved at 2.11 Å resolution. The structure shows a symmetric α2 homodimer typical of fold type I aminotransferases. An alaA deletion strain has no growth defect, but an alaA avtA double mutant forms small colonies on agar plates. An alaA avtA alaC triple mutant has a slow growth phenotype in liquid medium. The defects of the double and triple mutants can be rescued by addition of alanine. Fitness and competitive growth experiments were performed under different growth conditions. Particularly under oxygen-limiting conditions, the doubling time of the ΔalaA strain in minimal media is increased compared to growth in rich media. Under competitive growth conditions, the ΔalaA mutation confers a disadvantage compared to wild type even in rich media. alaA was identified in a screen for genes that reduce the lethal effects of stress. An alaA insertion mutant is more sensitive than wild type to mitomycin C and other stresses and less sensitive to 10% SDS. The alaA gene was first identified as a mutant with a leaky requirement for alanine or valine.

AlaB is one of three major alanine-synthesizing transaminases in *E. coli*. AlaB catalyzes a glutamate-pyruvate aminotransferase reaction, generating alanine from pyruvate with glutamate as the amino donor. This activity has been assayed in crude cell extracts, and the gene encoding AlaB had been isolated on a plasmid. Expression of alaB from a multicopy plasmid partially suppresses the growth defect of an ilvE alaA mutant strain.

AlaC is one of three major alanine-synthesizing transaminases in *E. coli*. A homology model of the enzyme based on the crystal structure of AlaA has been generated. An alaC deletion strain has no growth defect, but an alaA avtA alaC triple mutant has a slow growth phenotype in liquid medium. The defect can be rescued by addition of alanine. Fitness and competitive growth experiments were performed under different growth conditions. Particularly under oxygen-limiting conditions, the doubling time of the ΔalaC strain in minimal media is increased compared to growth in rich media; unlike for the alaA and avtA mutants, addition of L-alanine returns the doubling time to that observed in DMEM medium. Under competitive growth conditions, the ΔalaC mutation confers a disadvantage compared to wild type even in rich media. Expression of alaC is activated by the transcriptional regulator SgrR. AlaC may thus play a role in glucose-phosphate stress. However, an alaC deletion mutant does not show altered sensitivity to α-methylglucoside, which induces sugar-phosphate stress.

In *Homo sapiens*, alanine aminotransferase is a cytoplasmic enzyme that catalyzes the reversible transamination between L-alanine and 2-oxoglutarate to form pyruvate and L-glutamate. The interconversion of these four major metabolic intermediates gives this enzyme both degradative and biosynthetic roles. It participates in the alanine-glucose cycle of skeletal muscle and liver, gluconeogenesis, and glutamate generation in the brain. Alanine aminotransferase is expressed in kidney, skeletal muscle, adipose tissue and heart. There are two isoforms of the enzyme: alanine aminotransferase 1 (GPT) and alanine aminotransferase 2 (GPT2). Human alanine aminotransferase 1 (GPT) was purified from liver. Recombinant human alanine aminotransferase 2 (GPT2) from adipose tissue was expressed in *Escherichia coli* and the molecular mass was determined by SDS-PAGE. The enzyme is expressed at high levels in adipose tissue, muscle, brain and kidney and at lower levels in breast and liver.

The subunit structure of an alanine transaminase from the marine polychaete annelid *Arenicola marina* (lugworm) has not been reported. It has a native apparent molecular mass of 91 kDa as determined by gel filtration chromatography. The gene encoding it in this organism has not been identified. In marine annelids and mollusks this reaction participates in an anaerobic energy generation pathway that operates during periods of hypoxia or anoxia. Alanine transaminase (glutamate pyruvate transaminase) from this organism has been partially purified from body wall muscle and characterized. High alanine transaminase activity was found in this tissue. Specific, reversible, L-glutamate-dependent L-alanine transaminase and L-aspartate transaminase activities have also been demonstrated in tissues of the mussel *Mytilus edulis*.

The *Arabidopsis thaliana* tryptophan aminotransferase TAA1 protein is involved in the formation of indole-3-pyruvate, a precursor to indole-3-acetate (IAA), a biologically important auxin that acts as a phytohormone in many plant species. In vitro assays reveal that this pyridoxal 5'-phosphate (PLP)-dependent aminotransferase can act on a number of different L-amino acids, including L-phenylalanine, L-tyrosine, L-leucine, L-alanine, L-methionine, and L-glutamine using either pyruvate or 2-oxoglutarate as a cosubstrate. However, enzymatic assays, in silico docking experiments, and mutant phenotypic analyses all suggest that L-tryptophan is the in vivo substrate for this enzyme. TAA1 has a Km of 0.29 mM and a Vmax of 12.9 μM/min when tested with L-tryptophan and pyruvate. It is unclear whether pyruvate or 2-oxoglutarate is the more biologically relevant cosubstrate for this enzyme.

The gene encoding this protein was identified in screens for shade avoidance mutants and mutants with a weak ethylene insensitivity suggesting that the auxin synthesized through a TAA1-mediated pathway is particularly important for the responses to specific environmental and hormonal stimuli. In addition, normal developmental processes, such as embryogenesis, that require proper auxin levels, are disrupted when TAA1 and one or more of its closely related family members (i.e. TAR1 and TAR2) are knocked-out in *Arabidopsis* plants. This enzyme activity appears to be widely distributed in the plant kingdom, based on the ability of enzymatic extracts from 30 different species distributed among 16 families, to catalyze the formation of IPA in a transaminase reaction. Three species of algae also have this activity.

In *Arabidopsis thaliana*, alanine transaminases with four aminotransferase activities have been identified. AOAT1 (GGAT1) is peroxisomal located. Knock-out plants have reduced activity of AOAT, GPAT (glutamate:pyruvate aminotransferase), AGAT (alanine:glyoxylate aminotransferase) and GGAT (glutamate:glyoxylate aminotransferase). The GGAT and AGAT activities were reduced most drastically. These indicate AOAT1 is primarily involved in photorespiration. Similary, AOAT2 (GGAT2), which is predicted to be located in the peroxisome, is likely involved in photorespiration. In vitro assay of the recombinant proteins indicated that GGAT1 and GGAT2 have four aminotransferase activities, namely GGAT, AGAT, GPAT and AOAT. The two recombinant proteins exhibited very similar Km values towards amino acid substrates glutamate and alanine, as well as the oxoacid substrates glyoxylate, pyruvate and 2-oxoglutarate.

Alanine aminotransferase activities have also been described from *Candida maltose*, *Clostridium propionicum*, *Pyrococcus furiosus*, *Megathyrsus maximus* and *Panicum miliaceum*. The *Panicum miliaceum* putative alanine aminotransferase was cloned from this NAD-ME type C4 plant and found to express in both mesophyll and bundle sheath cells, and the gene expression was light-inducible. The mRNA accumulation increased dramatically during greening in both cell types which is in agreement with its predicted role in C4 photosynthesis.

In some embodiments, the enzyme having alanine transaminase activity is encoded by an amino acid sequence having at least 70% sequence identity, having at least 80% sequence identity, or having at least 90% sequence identity to an enzyme having alanine transaminase activity selected from *E. coli* glutamate-pyruvate aminotransferase alaA, *E. coli* glutamate-pyruvate aminotransferase alaB, *E. coli* glutamate-pyruvate aminotransferase alaC, *Homo sapiens* alanine aminotransferase 1 (GPT), *Homo sapiens* alanine aminotransferase 2 (GPT2), *Arenicola marina* alanine transaminase, *Arabidopsis thaliana* tryptophan aminotransferase TAA1, *Arabidopsis thaliana* AOAT1, *Arabidopsis thaliana* AOAT2, *Candida maltosa* alanine aminotransferase, *Clostridium propionicum* alanine aminotransferase, *Pyrococcus furiosus* alanine aminotransferase aat, *Megathyrsus maximus* alanine transaminase, and *Panicum miliaceum* alanine transaminase AlaAT-2. In some embodiments, the one or more nucleic acid molecule encoding enzyme having alanine transaminase activity comprises an amino acid sequence selected from UniProt ID P0A959, UniProt ID P77434, UniProt ID P24298, UniProt ID Q8TD30, UniProt ID Q9S7N2, UniProt ID Q9LR30, UniProt ID Q9S7E9, UniProt ID Q9P9M8, and UniProt ID P34106. In a further embodiment, the one or more nucleic acid molecule encoding enzyme having alanine transaminase activity is encoded by a nucleic acid sequence selected from Gene ID 946772, Gene ID 946850, Gene ID 2875, Gene ID 84706, Gene ID 843393, TAIR accession AT1G23310, TAIR accession AT1G70580, GenBank accession AF163769.1 and GenBank accession X69421.1.

Glutamate Dehydrogenase (EC 1.4.1.2 and EC 1.4.1.3)

The present disclosure describes enzymes that can catalyze the following reactions:

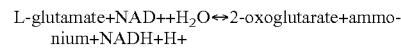

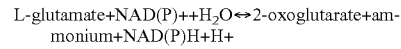

In some embodiments, the glutamate dehydrogenase is an NAD-dependent glutamate dehydrogenase from *Saccharomyces cerevisiae* (GDH2) that degrades glutamate to ammonia and alpha-ketoglutarate. Expression of GDH2 is sensitive to nitrogen catabolite repression and intracellular ammonia levels.

There are two NAD-dependent glutamate dehydrogenase (GDH) genes in *Arabidopsis*, GDH1 and GDH2, encoding the alpha- and beta-subunits, respectively. Seven hexameric isoforms of GDH have been detected which are composed of different ratios of the alpha and beta subunits. Different isoforms are distributed in different tissues under different environmental and physiological conditions. The enzyme activity of GDH is controlled in part at the transcriptional level.

Glutamate dehydrogenase from *Peptoniphilus asaccharolyticus* catalyzes the NAD-dependent, oxidative deamination of L-glutamate to 2-oxoglutarate. The reaction is highly substrate specific. No activity was observed in the presence of D-glutamate, D- or L-asparate, glutamine or when NADP replaced NAD. Using sucrose gradient density centrifugation, researchers estimated that the molecular weight of the native enzyme was between 300-340 kDa, suggesting that the enzyme may be a homohexamer. Other researchers, on the other hand, estimated that the molecular weight of the native enzyme was approximately 226 kDa, using gel filtration. The Km values for L-glutamate and NAD+ were 1.3 mM and 0.25 mM, respectively.

*Halobacterium salinarum* is one of the organisms reported to have more than one form of GDH, with different forms utilizing different cofactors (NAD and NADP). It was eventually shown that the organism has four genes encoding four different glutamate dehydrogenase enzymes. Two of these gene products have been purified and characterized biochemically. One of the genes, gdhA1, which was originally predicted to encode an NADP-specific form, was found to encode an NAD-specific enzyme.

*Homo sapiens* glutamate dehydrogenases (GDHs) are homohexameric mitochondrial matrix enzymes that catalyze the reversible oxidative deamination of L-glutamate to 2-oxoglutarate and ammonia. Mammalian GDHs are unusual enzymes, in that they are able to use either NAD or NADP as a co-factor. Humans express two GDH isoenzymes. Glutamate dehydrogenase 1 (GLUD1) is expressed at high levels in liver, brain, pancreas and kidney. Glutamate dehydrogenase 2 (GLUD2) is encoded by an X chromosome-linked intronless gene and is expressed in retina, testis, and brain. Mutations in GLUD1 that lead to enzyme overactivity, result in hyperinsulinemia. Allosteric control of mammalian GDH activity by positive effectors like ADP and L-leucine and negative effectors like GTP have been extensively studied.

*Bacillus subtilis* PCI 219 has a single glutamate dehydrogenase (GDH) with dual coenzyme specificity for NAD(H) and NADP(H). Its molecular weight was estimated to be 250,000+/−20,000 by gel filtration, and 270,000+/−30,000 by zone centrifugation in a sucrose density gradient. The subunit size was about 57,000, suggesting that it is a homotetramer.

A cDNA clone was isolated from *Solanum lycopersicum* tissues. The cDNA encoded a protein that shares identity with glutamate dehydrogenase (GDH) of plants. Expression analysis of this protein showed that it is expressed in stems, roots and leaves but is absent in fruit tissues. The study also showed that the two subunits of tomato GDH1 were encoded by a single gene. This enzyme converts 2-oxoglutarate to L-glutamate.

Glutamate dehydrogenase activities have also been described from *Clostridium propionicum* and *Thermotoga maritima*.

In some embodiments, the enzyme having glutamate dehydrogenase activity is encoded by an amino acid sequence having at least 70% sequence identity, having at least 80% sequence identity, or having at least 90% sequence identity to a glutamate dehydrogenase selected from *Saccharomyces cerevisiae* NAD-dependent glutamate dehydrogenase GDH2, *Arabidopsis thaliana* NAD-dependent glutamate dehydrogenase GDH2, *Arabidopsis thaliana* NAD-dependent glutamate dehydrogenase GDH1, *Peptoniphilus asaccharolyticus* NAD-dependent glutamate dehydrogenase gdhA, *Halobacterium salinarum* NAD-dependent glutamate dehydrogenase gdhA, *Thermotoga maritima* glutamate dehydrogenase, *Homo sapiens* glutamate dehydrogenase 1 (GLUD1), *Homo sapiens* glutamate dehydrogenase 2 (GLUD2), *Bacillus subtilis* glutamate dehydrogenase and *Solanum lycopersicum* glutamate dehydrogenase GDH1. In some embodiments, the one or more nucleic acid molecule encoding an enzyme having glutamate dehydrogenase activity comprises an amino acid sequence selected from UniProt ID P33327, UniProt ID Q38946, UniProt ID Q38946, UniProt ID P28997, UniProt ID P29051, UniProt ID P00367, UniProt ID P49448 and UniProt ID P93541. In a further embodiment, the one or more nucleic acid molecule encoding an enzyme having glutamate dehydrogenase activity is encoded by a nucleic acid sequence selected from Gene ID 461927, TAIR accession AT5G07440, TAIR accession AT5G18170, GenBank accession M76403.1, GenBank accession X63837.1, Gene ID 2746, Gene ID 2747 and GenBank accession U48695.1.

Acetaldehyde Dehydrogenase (EC 1.2.1.10)

The present disclosure describes enzymes that can catalyze the following reaction:

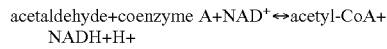

acetaldehyde+coenzyme A+NAD⁺↔acetyl-CoA+ NADH+H+

*E. coli* mhpF encodes an acylating acetaldehyde dehydrogenase. MhpF is active as a monomer; the rate-limiting step of the reaction appears to be transthioesterification. MhpF is involved in synthesis of n-butanol in an engineered reversal of the β-oxidation pathway. The expression of MhpE is translationally coupled to MhpF, and interaction between the two proteins appears to be required for solubility of MhpE.

*E. coli* AdhE is a homopolymeric protein with three $Fe^{2+}$-dependent catalytic functions: alcohol dehydrogenase, coenzyme A-dependent acetaldehyde dehydrogenase, and pyruvate formate-lyase deactivase. However, the existence of the pyruvate formate-lyase deactivase activity of AdhE has been debated. The homopolymeric structure of AdhE is unusual in that 20-60 subunits are helically arranged to form rod-like ultrastructures. Under fermentative conditions AdhE catalyzes the reduction of acetyl-CoA to acetaldehyde and the latter compound to ethanol. Aerobically, in the reverse direction, AdhE can catalyze the oxidation of acetaldehyde to acetyl-CoA. Expression of adhE appears to be regulated at the transcriptional and translational levels, and possibly at the posttranslational level. Expression of adhE is approximately 10-fold higher during anaerobic growth than during aerobic growth. The AdhE from *E. coli* B was partially purified and characterized in early work. It was later purified to homogeneity from *E. coli* B and its coenzyme A-linked aldehyde dehydrogenase activity was subjected to detailed kinetic analysis. A bi-uni-uni-uni ping-pong mechanism was proposed. AdhE from *Salmonella enterica* subsp. *enterica* serovar *Typhimurium* showed 70% amino acid sequence identity to that of *E. coli*. It had a lower Km for alcohol substrates and some differences in substrate specificity as compared to the *E. coli* enzyme. In the metabolic engineering field, deletion of adhE is a determinant in the production of compounds such as succinate, D-lactate, and polyhydroxyalkanoates.

*Chlamydomonas reinhardtii* ADH1 encodes a dual function alcohol dehydrogenase/acetaldehyde dehydrogenase. It appears to be active under anoxic conditions and participates in two different anaerobic ethanol production pathways in *Chlamydomonas*.

DmpF is an acylating acetaldehyde dehydrogenase from *Pseudomonas* sp. The final two steps of the meta-cleavage pathway in *Pseudomonas* sp. CF600 involve the conversion of (S)-4-hydroxy-2-oxopentanoate to pyruvate and acetyl-CoA by the enzymes 4-hydroxy-2-oxovalerate aldolase and acetaldehyde dehydrogenase (acylating). Biochemical studies demonstrated that these two enzymes comprise a bifunctional aldolase-dehydrogenase heterodimer, and suggest that the product of the aldolase reaction, acetaldehyde, is transferred to the dehydrogenase active site via a channeling mechanism. This minimizes the risk to the cells posed by the toxic acetaldehyde.

The presence of the todI gene product in *Pseudomonas putida* F1 was suggested by the protein expression pattern of plasmid constructs. The predicted amino acid sequence of the todI gene product showed very high identity with other bacterial acylating aldehyde dehydrogenase gene products.

The adhE gene of *Clostridium acetobutylicum* ATCC 824 encodes a multifunctional enzyme that has both alcohol dehydrogenase and acetaldehyde dehydrogenase activities. Both activities are necessary for the formation of butan-1-ol and ethanol during solventogenesis. The adhE gene is part of the sol operon, which is located on the pSOL1 megaplasmid. Expression of the gene from a plasmid in *Clostridium acetobutylicum* ATCC 824 resulted in elevated activities of NADH-dependent butanol dehydrogenase, NAD-dependent acetaldehyde dehydrogenase and butyraldehyde dehydrogenase, and a small increase in NADH-dependent ethanol dehydrogenase. Complementation of a mutant deficient in butyraldehyde dehydrogenase, acetoacetate decarboxylase, and acetoacetyl-coenzyme A:acetate/butyrate:coenzyme A-transferase activities, which produces neither butanol nor acetone, by the adhE gene resulted in restored butanol formation without any acetone formation or any significant increase in ethanol production, suggesting that the primary role of the enzyme is in butanol formation, providing both a butanal dehydrogenase activity (converting butanoyl-CoA to butan-1-al) and butanol dehydrogenase activity. In addition, inactivation of the gene drastically reduced butanol production (by 85%), supporting this role. Another gene from the pSOL1 plasmid, adhE2, encodes a second multifunctional aldehyde/alcohol dehydrogenase involved in butanol production. However, that enzyme is produced only under alcohologenic conditions, and is not expressed under solventogenic conditions. The gene from strain ATCC 824 was originally called aad.

Acetaldehyde dehydrogenase activities have also been described from *Leuconostoc mesenteroides, Pelobacter acetylenicus* and *Pseudomonas putida*. The partially purified *Leuconostoc mesenteroides* CoA-dependent aldehyde dehydrogenase could not be separated from an NAD-linked alcohol dehydrogenase that co-purified with it. The enzyme was specific to NAD and could not use NADP. While acetaldehyde and 1-propanal were the best substrates, the enzyme could also use butan-1-al (31% of activity with acetaldehyde) and isobutanal (14%).

In some embodiments, the enzyme having acetaldehyde dehydrogenase activity is encoded by an amino acid sequence having at least 70% sequence identity, having at least 80% sequence identity, or having at least 90% sequence identity to an enzyme having acetaldehyde dehydrogenase activity selected from *E. coli* mhpF, *E. coli* AdhE, *Chlamydomonas reinhardtii* ADH1, *Leuconostoc mesenteroides* CoA-dependent acetaldehyde dehydrogenase, *Pelobacter acetylenicus* acetaldehyde dehydrogenase, *Pseudomonas* sp. dmpF, *Pseudomonas putida* acylating aldehyde dehydrogenase todI, *Pseudomonas putida* acetaldehyde dehydrogenase cmtH and *Clostridium acetobutylicum* alcohol/aldehyde dehydrogenase AdhE. In some embodiments, the one or more nucleic acid molecule encoding an enzyme having acetaldehyde dehydrogenase activity comprises an amino acid sequence selected from UniProt ID P77580, UniProt P0A9Q7, UniProt ID A8J107, UniProt ID Q52060, UniProt ID Q51949 and UniProt ID P33744. In a further embodiment, the one or more nucleic acid molecule encoding an enzyme having acetaldehyde dehydrogenase activity is encoded by a nucleic acid sequence selected from Gene ID 945008, Gene ID 945837, Gene ID 5729132, GenBank accession X60835.1, GenBank accession U09250.1 and Gene ID 1116167.

Ethanolamine Ammonia Lyase (EC 4.3.1.7)

The present disclosure describes enzymes that can catalyze the following reaction:

ammonium+acetaldehyde ↔ ethanolamine

Ethanolamine ammonia-lyase (EAL) allows *E. coli* to utilize ethanolamine as the sole source of nitrogen and carbon in the presence of external vitamin B12. EAL is an adenosylcobalamin-dependent enzyme that is spontaneously inactivated by its substrate and can be reactivated by EutA. The enzyme was first studied in the non-K-12 strain NCIB 8114. Crystal structures of an N-terminally truncated, but active form of the enzyme both in binary and ternary complexes with the cofactor and substrate have been solved. The enzyme is composed of a hexamer of $(\alpha\beta)2$ dimers, with the $\alpha$ subunit holding the active site and the cobalamin cofactor bound at the interface between the $\alpha$ and $\beta$ subunits. The authors propose a reaction mechanism that is consistent with a previously described mechanism for adenosylcobalamin-dependent rearrangements. The stereochemical course of the reaction has been modeled on the basis of crystal structures, accounting for the apparent lack of stereospecificity of the enzyme. Production of EAL is catabolite repressed and is induced by the simultaneous presence of ethanolamine and the adenosylcobalamin cofactor. Ethanolamine ammonia-lyase comprises two subunits, $\alpha$ (EutB) and $\beta$ (EutC).

In some embodiments, the enzyme having ethanolamine ammonia lyase activity is encoded by an amino acid sequence having at least 70% sequence identity, having at least 80% sequence identity, or having at least 90% sequence identity to an *E. coli* enzyme having ethanolamine ammonia lyase activity. In some embodiments, the one or more nucleic acid molecule encoding an ethanolamine ammonia lyase subunit comprises an amino acid sequence selected from UniProt ID P0AEJ6 and UniProt ID P19636. In a further embodiment, the one or more nucleic acid molecule encoding an ethanolamine ammonia lyase subunit is encoded by a nucleic acid sequence selected from Gene ID 946924 and Gene ID 946925.

Serine Aminase (EC 2.6.1.-)

The present disclosure describes enzymes that can catalyze the following reaction:

L-Serine+$NH_4^+$→(S)-2,3-diaminopropanoate

In some embodiments, an enzyme having serine aminase activity can be a serine-glyoxylate transaminase. In other embodiments, an enzyme having serine aminase activity can be a serine-pyruvate transaminase (see above).

Serine-glyoxylate aminotransferase catalyzes the transfer of the $\alpha$-amino group of L-serine to glyoxylate, forming glycine and hydroxypyruvate. In the serine-cycle methylotrophs this enzyme plays two important roles: the formation of an acceptor (glycine) for a one-carbon unit, and the conversion of L-serine to hydroxypyruvate in the assimilatory pathway. This is the first microbial serine-glyoxylate aminotransferase to be purified, and a few years later the gene encoding it was identified as well.

Serine: glyoxylate aminotransferase encoded by *Arabidopsis thaliana* AGT1 is a homodimer. The purified recombinant protein has the highest activity with the serine: glyoxylate transamination. It also catalyzed alanine: glyoxylate transamination and serine: pyruvate transamination with much lower specific activity.

sgaA is presumed to be the gene encoding serine-glyoxylate aminotransferase on the *Methylobacterium extorquens* chromosome. While the product of the cloned gene has not been expressed, mutation complementation was used to investigate its role. Mutations in this gene have abolished the ability to grow on C1 compounds, and complementation of the mutants by a cloned intact version of the gene fragment has restored activity. In addition, sgaA sequence is similar to a number of aminotransferases.

In further embodiments, an enzyme having serine aminase activity can be an enzyme having phosphoserine aminotransferase activity. In some embodiments, the one or more nucleic acid molecules encoding the phosphoserine aminotransferase is serC, or homolog thereof. In another embodiment, the one or more nucleic acid molecules encoding an enzyme having phosphoserine aminotransferase activity, an enzyme having L-serine transaminase activity, or an enzyme having serine aminotransferase activity comprise an amino acid sequence set forth in SEQ ID NO: 230. In a further embodiment, the one or more nucleic acid molecule encoding an enzyme having phosphoserine aminotransferase activity, an enzyme having L-serine transaminase activity, or an enzyme having serine aminotransferase activity is encoded by a nucleic acid sequence set forth in SEQ ID NO: 229. In some embodiments, the enzyme having phosphoserine aminotransferase activity is *Homo sapiens* PSAT1, or homolog thereof. In one embodiment, the one or more nucleic acid molecule encoding an enzyme having phosphoserine aminotransferase activity comprises an amino acid sequence set forth in UniProt ID Q9Y617. In another embodiment, the one or more nucleic acid molecule encoding an enzyme having phosphoserine aminotransferase activity is encoded by a nucleic acid sequence set forth in Gene ID 29968.

In some embodiments, the enzyme having serine aminase activity is encoded by an amino acid sequence having at least 70% sequence identity, having at least 80% sequence identity, or having at least 90% sequence identity to an *Arabidopsis thaliana* serine-glyoxylate aminotransferase AGT1, *Hyphomicrobium methylovorum* GM2 serine-glyoxylate aminotransferase sgaA and *Methylobacterium extorquens* sgaA. In some embodiments, the one or more nucleic acid molecule encoding an enzyme having serine-glyoxylate aminotransferase activity comprises an amino acid sequence selected from UniProt ID Q56YA5 and Uni-Prot ID O08374. In a further embodiment, the one or more nucleic acid molecule encoding an enzyme having serine-glyoxylate aminotransferase activity is encoded by a nucleic acid sequence selected from TAIR accession AT2G13360, GenBank accession D86125.1 and GenBank accession L27235.1.

In some embodiments, an enzyme having serine aminase activity is a serine-pyruvate aminotransferase. In some embodiments, the serine-pyruvate aminotranserase is encoded by an amino acid sequence having at least 70% sequence identity, having at least 80% sequence identity, or having at least 90% sequence identity to *Homo sapiens* AGXT1. In some embodiments, the serine-pyruvate aminotransferase is *Homo sapiens* AGXT1. In some embodiments, the one or more nucleic acid molecules encoding the serine-pyruvate aminotranserase is AGXT1, or homolog thereof. In some embodiments, the one or more nucleic acid molecules encoding a serine-pyruvate aminotransferase comprise an amino acid sequence set forth in SEQ ID NO: 244. In a further embodiment, the one or more nucleic acid molecule encoding a serine-pyruvate aminotranserase is encoded by a nucleic acid sequence set forth in SEQ ID NO: 243.

In some embodiments, an enzyme having serine aminase activity is an enzyme having alanine-glyoxylate aminotransferase activity. In some embodiments, the enzyme having alanine-glyoxylate aminotransferase activity is encoded by an amino acid sequence having at least 70% sequence identity, having at least 80% sequence identity, or having at least 90% sequence identity to an enzyme having alanine-glyoxylate aminotransferase activity selected from *Saccharomyces cerevisiae* AGX1, *Homo sapiens* AGXT2, *Arabidopsis thaliana* AOAT1 and *Arabidopsis thaliana* AOAT2. In some embodiments, the one or more nucleic acid molecule encoding an enzyme having alanine-glyoxylate aminotransferase activity comprises an amino acid sequence selected from UniProt ID P43567, UniProt ID Q9BYV1, UniProt ID Q9LR30 and UniProt ID Q9S7E9. In a further embodiment, the one or more nucleic acid molecule encoding an enzyme having alanine-glyoxylate aminotransferase activity is encoded by a nucleic acid sequence selected from Gene ID 850514, Gene ID 64902, TAIR accession AT1G23310 and TAIR accession AT1G70580.

In some embodiments, an enzyme having serine aminase activity is an enzyme having alanine transaminase activity. In some embodiments, the enzyme having alanine transaminase activity is encoded by an amino acid sequence having at least 70% sequence identity, having at least 80% sequence identity, or having at least 90% sequence identity to an enzyme having alanine transaminase activity selected from *E. coli* glutamate-pyruvate aminotransferase alaA, *E. coli* glutamate-pyruvate aminotransferase alaB, *E. coli* glutamate-pyruvate aminotransferase alaC, *Homo sapiens* alanine aminotransferase 1 (GPT), *Homo sapiens* alanine aminotransferase 2 (GPT2), *Arenicola marina* alanine transaminase, *Arabidopsis thaliana* tryptophan aminotransferase TAA1, *Arabidopsis thaliana* AOAT1, *Arabidopsis thaliana* AOAT2, *Candida maltosa* alanine aminotransferase, *Clostridium propionicum* alanine aminotransferase, *Pyrococcus furiosus* alanine aminotransferase aat, *Megathyrsus maximus* alanine transaminase, and *Panicum miliaceum* alanine transaminase AlaAT-2. In some embodiments, the one or more nucleic acid molecule encoding an enzyme having alanine transaminase activity comprises an amino acid sequence selected from UniProt ID P0A959, UniProt ID P77434, UniProt ID P24298, UniProt ID Q8TD30, UniProt ID Q9S7N2, UniProt ID Q9LR30, UniProt ID Q9S7E9, UniProt ID Q9P9M8, and UniProt ID P34106. In a further embodiment, the one or more nucleic acid molecule encoding an enzyme having alanine transaminase activity is encoded by a nucleic acid sequence selected from Gene ID 946772, Gene ID 946850, Gene ID 2875, Gene ID 84706, Gene ID 843393, TAIR accession AT1G23310, TAIR accession AT1G70580, GenBank accession AF163769.1 and GenBank accession X69421.1.

2,3-Diaminopropionate Ammonia-Lyase (EC 4.3.1.15)

The present disclosure describes enzymes that can catalyze the following reaction:

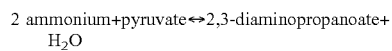

2,3-Diaminopropionate ammonia-lyase is not stereospecific and catalyzes the α,β-elimination of both the D and L stereoisomer of 2,3-diaminopropionate. The enzyme also exhibits weak activity toward D-serine, and does not exhibit activity toward L-serine, D-β-Cl-alanine, or L-β-Cl-alanine.

The enzyme is homodimeric and contains a pyridoxal 5'-phosphate prosthetic group, belonging to the fold-type II family of PLP-containing enzymes. Crystal structures of the apo- and holoenzyme and the enzyme in complex with a reaction intermediate and substrate have been solved. Kinetic properties of mutants in active site residues were analyzed, and a reaction mechanism was proposed.

In some embodiments, an enzyme having 2,3-diaminopropionate ammonia-lyase activity is encoded by an amino acid sequence having at least 70% sequence identity, having at least 80% sequence identity, or having at least 90% sequence identity to *E. coli* 2,3-diaminopropionate ammonia-lyase ygeX. In other embodiments, the enzyme having 2,3-diaminopropionate ammonia-lyase activity is *E. coli* ygeX. In some embodiments, the one or more nucleic acid molecule encoding an enzyme having 2,3-diaminopropionate ammonia-lyase activity comprises an amino acid sequence set forth in UniProt ID P66899. In further embodiments, the one or more nucleic acid molecule encoding an enzyme having 2,3-diaminopropionate ammonia-lyase activity is encoded by a nucleic acid sequence set forth in Gene ID 947012.

Glyoxylate Shunt

The glyoxylate cycle, a variation of the tricarboxylic acid cycle, is an anabolic pathway occurring in plants, bacteria, protists, and fungi. The glyoxylate cycle centers on the conversion of acetyl-CoA to succinate for the synthesis of carbohydrates. In microorganisms, the glyoxylate cycle allows cells to utilize simple carbon compounds as a carbon source when complex sources such as glucose are not available. The cycle is generally assumed to be absent in animals, with the exception of nematodes at the early stages of embryogenesis. In recent years, however, the detection of malate synthase and isocitrate lyase, key enzymes involved in the glyoxylate cycle, in some animal tissue has raised questions regarding the evolutionary relationship of enzymes in bacteria and animals and suggests that animals encode alternative enzymes of the cycle that differ in function from known malate synthase and isocitrate lyase in non-metazoan species.

The glyoxylate cycle utilizes five of the eight enzymes associated with the tricarboxylic acid cycle: citrate synthase, aconitase, succinate dehydrogenase, fumarase, and malate dehydrogenase. The two cycles differ in that in the glyoxylate cycle, isocitrate is converted into glyoxylate and succinate by isocitrate lyase instead of into α-ketoglutarate. This bypasses the decarboxylation steps that take place in the TCA cycle, allowing simple carbon compounds to be used in the later synthesis of macromolecules, including glucose. Glyoxylate is subsequently combined with acetyl-CoA to produce malate, catalyzed by malate synthase. Malate is also formed in parallel from succinate by the action of succinate dehydrogenase and fumarase.

Fatty acids from lipids are commonly used as an energy source by vertebrates as fatty acids are degraded through beta oxidation into acetate molecules. This acetate, bound to the active thiol group of coenzyme A, enters the citric acid cycle (TCA cycle) where it is fully oxidized to carbon dioxide. This pathway thus allows cells to obtain energy from fat. To utilize acetate from fat for biosynthesis of carbohydrates, the glyoxylate cycle, whose initial reactions are identical to the TCA cycle, is used.

Cell-wall containing organisms, such as plants, fungi, and bacteria, require very large amounts of carbohydrates during growth for the biosynthesis of complex structural polysaccharides, such as cellulose, glucans, and chitin. In these organisms, in the absence of available carbohydrates (for example, in certain microbial environments or during seed germination in plants), the glyoxylate cycle permits the synthesis of glucose from lipids via acetate generated in fatty acid β-oxidation.

The glyoxylate cycle bypasses the steps in the citric acid cycle where carbon is lost in the form of $CO_2$. The two initial steps of the glyoxylate cycle are identical to those in the citric acid cycle: acetate→citrate→isocitrate. In the next step, catalyzed by the first glyoxylate cycle enzyme, isocitrate lyase, isocitrate undergoes cleavage into succinate and glyoxylate (the latter gives the cycle its name). Glyoxylate condenses with acetyl-CoA (a step catalyzed by malate synthase), yielding malate. Both malate and oxaloacetate can be converted into phosphoenolpyruvate, which is the product of phosphoenolpyruvate carboxykinase, the first enzyme in gluconeogenesis. The net result of the glyoxylate cycle is therefore the production of glucose from fatty acids. Succinate generated in the first step can enter into the citric acid cycle to eventually form oxaloacetate.

Biosynthesis of MEG (or Glycolic Acid), or MEG (or GA) and One or More Co-Product Using a Recombinant Microorganism As discussed above, in one aspect, the present disclosure provides a recombinant microorganism comprising one or more biochemical pathway that produces one or more products derived from D-glyceraldehyde-3-phosphate (G3P) and glycolaldehyde from one or more pentose and/or hexose sugars via a pentose-phosphate intermediate. In one embodiment, the recombinant microorganism co-produces monoethylene glycol (MEG) and one or more co-products. In another embodiment, the one or more co-products are selected from acetone, isopropanol, propene, L-serine, glycine, monoethanolamine (MEA), ethylenediamine, or a combination thereof. In yet a further embodiment, the one or more product is selected from monoethylene glycol (MEG) and glycolic acid (GA).

Therefore, in one embodiment, the application relates to a recombinant microorganism comprising one or more biochemical pathway comprising at least one enzyme having an activity that converts one or more pentose and/or hexose sugars in a lossless conversion to pentose-phosphate intermediate and comprising at least one enzyme having a pentose-phosphate aldolase activity that converts the pentose-phosphate intermediate to glycolaldehyde and D-glyceraldehyde-3-phosphage (G3P).

In some embodiments, the pentose-phosphate intermediate is D-ribose-5-phosphate, D-ribulose-5-phosphate or D-xylulose-5-phosphate. In some embodiments, the at least one enzyme having pentose-phosphate aldolase activity has D-ribose-5-phosphate aldolase activity, D-ribulose-5-phosphate aldolase activity, or D-xylulose-5-phosphate aldolase activity.

In some embodiments, the recombinant microorganism comprises expression of at least one enzyme having transketolase activity and expression of at least one enzyme having pentose-phosphate aldolase activity. In some embodiments, the enzyme having transketolase activity is encoded by an amino acid sequence having at least 70% sequence identity, at least 80% sequence identity, or at least 90% sequence identity to tktA from *E. coli*. In other embodiments, the enzyme having transketolase activity is tktA from *E. coli*. In some embodiments, the enzyme having transketolase activity is encoded by an amino acid sequence having at least 70% sequence identity at least 80% sequence identity, or at least 90% sequence identity to tktB from *E. coli*. In other embodiments, the enzyme having transketolase activity is tktB from *E. coli*. In another embodiment, the one or more nucleic acid molecules encoding the enzyme having transketolase activity comprises an amino acid sequence selected from the group consisting of SEQ ID NOs: 148 and 150. In some embodiments, the one or more nucleic acid molecules encoding the enzyme having transketolase activity is tktA, or homolog thereof. In some embodiments, the one or more nucleic acid molecules encoding the enzyme having transketolase activity is tktB, or homolog thereof. In a further embodiment, the one or more nucleic acid molecule encoding the enzyme having transketolase activity is encoded by a nucleic acid sequence selected from the group consisting of SEQ ID NOs: 147 and 149. In some embodiments, the enzyme having pentose-phosphate aldolase activity is encoded by an amino acid sequence having at least 70% sequence identity, at least 80% sequence identity, or at least 90% sequence identity to deoC from *E. coli*. In other embodiments, the enzyme having pentose-phosphate aldolase activity is deoC from *E. coli*.

In some embodiments, the recombinant microorganism comprises expression of at least one enzyme having transaldolase activity. In some embodiments, the enzyme having transaldolase activity is encoded by an amino acid sequence having at least 70% sequence identity, at least 80% sequence identity, or at least 90% sequence identity to talA or talB from *E. coli*. In some embodiments, the enzyme having transaldolase activity is talA from *E. coli*. In other embodiments, the enzyme having transaldolase activity is talB from *E. coli*. In another embodiment, the one or more nucleic acid molecules encoding the enzyme having transaldolase activity comprises an amino acid sequence selected from the group consisting of SEQ ID NOs: 152 and 154. In a further embodiment, the one or more nucleic acid molecule encoding the enzyme having transaldolase activity is encoded by a nucleic acid sequence selected from the group consisting of SEQ ID NOs: 151 and 153.

In some embodiments, the recombinant microorganism comprises expression of at least one enzyme having ribulose-5-phosphate 3-epimerase activity. In some embodiments, the enzyme having ribulose-5-phosphate 3-epimerase activity is encoded by an amino acid sequence having at least 70% sequence identity, at least 80% sequence identity, or at least 90% sequence identity to rpe from *E. coli*. In other embodiments, the enzyme having ribulose-5-phosphate 3-epimerase activity is rpe from *E. coli*. In another embodiment, the one or more nucleic acid molecules encoding the enzyme having ribulose-5-phosphate 3-epimerase activity comprise an amino acid sequence set forth in SEQ ID NO: 158. In a further embodiment, the one or more nucleic acid molecule encoding the enzyme having ribulose-5-phosphate 3-epimerase activity is encoded by a nucleic acid sequence set forth in SEQ ID NO: 157.

In some embodiments, the recombinant microorganism comprises expression of at least one enzyme having ribose-5-phosphate isomerase activity. In some embodiments, the enzyme having ribose-5-phosphate isomerase activity is encoded by an amino acid sequence having at least 70% sequence identity, at least 80% sequence identity, or at least 90% sequence identity to rpiA from *E. coli*. In other embodiments, the enzyme having ribose-5-phosphate isomerase activity is rpiA from *E. coli*. In other embodiments, the enzyme having ribose-5-phosphate isomerase activity is encoded by an amino acid sequence having at least 70% sequence identity, at least 80% sequence identity, or at least 90% sequence identity to rpiB from *E. coli*. In other embodiments, the enzyme having ribose-5-phosphate isomerase activity is rpiB from *E. coli*. In another embodiment, the one or more nucleic acid molecules encoding enzyme having ribose-5-phosphate isomerase activity comprise an amino acid sequence set forth in SEQ ID NO: 156. In a further embodiment, the one or more nucleic acid molecule encoding the enzyme having ribose-5-phosphate isomerase activity is encoded by a nucleic acid sequence set forth in SEQ ID NO: 155.

In some embodiments, the recombinant microorganism comprising expression of at least one enzyme having an activity selected from a transketolase activity, a transaldolase activity, a ribulose-5-phosphate 3-epimerase activity, a ribose-5-phosphate isomerase activity and a D-ribose-5-phosphate aldolase activity, further comprises a deleted or diminished activity in one or more endogenouse enzymes selected from glyceraldehyde 3-phosphate dehydrogenase, phosphoglycerate kinase and phosphoglycerate mutase. In some embodiments, the endogenous glyceraldehyde 3-phosphate dehydrogenase enzyme is gapA, the phosphoglycerate kinase is pgk and the phosphoglycerate mutase is gpmA or gpmM.

In some embodiments, the recombinant microorganism comprises expression of at least one enzyme having fructose-6-phosphate phosphoketolase activity. In some embodiments, an enzyme having fructose-6-phosphate phosphoketolase activity is encoded by an amino acid sequence having at least 70% sequence identity, at least 80% sequence identity, or at least 90% sequence identity to an enzyme having fructose-6-phosphate phosphoketolase activity selected from the group consisting of *Bifidobacterium dentium* BDP_1006, *Bifidobacterium lactis* xfp, *Lactobacillus paraplantarum* xpkA and *Bifidobacterium breve* xfp. In a preferred embodiment, an enzyme having fructose-6-phosphate phosphoketolase activity is selected from the group consisting of *Bifidobacterium dentium* BDP_1006, *Bifidobacterium lactis* xfp, *Lactobacillus paraplantarum* xpkA and *Bifidobacterium breve* xfp. In another embodiment, the one or more nucleic acid molecules encoding the enzyme having fructose-6-phosphate phosphoketolase activity comprise an amino acid sequence selected from the group consisting of SEQ ID NOs: 212, 214, 216 and 218. In a further embodiment, the one or more nucleic acid molecule encoding the enzyme having fructose-6-phosphate phosphoketolase activity is encoded by a nucleic acid sequence selected from the group consisting of SEQ ID NOs: 211, 213, 215 and 217.

In some embodiments, the recombinant microorganism comprises expression of at least one enzyme having phosphate acetyltransferase activity. In some embodiments, an enzyme having phosphate acetyltransferase activity is encoded by an amino acid sequence having at least 70% sequence identity, at least 80% sequence identity, or at least 90% sequence identity to an enzyme having phosphate acetyltransferase activity selected from *E. coli* pta and *Clostridium acetobutylicum* pta. In a preferred embodiment, an enzyme having phosphate acetyltransferase activity is selected from *E. coli* pta and *Clostridium acetobutylicum* pta. In another embodiment, the one or more nucleic acid molecules encoding the enzyme having phosphate acetyltransferase activity comprise an amino acid sequence selected from SEQ ID NOs: 220 and 222. In a further embodiment, the one or more nucleic acid molecule encoding the enzyme having phosphate acetyltransferase activity is encoded by a nucleic acid sequence selected from SEQ ID NOs: 219 and 221.

In some embodiments, the recombinant microorganism comprising expression of at least one enzyme having an activity selected from a fructose-6-phosphate phosphoketolase activity, a phosphate acetyltransferase activity, a transketolase activity, a transaldolase activity, a ribulose-5-phosphate 3-epimerase activity, a ribose-5-phosphate isomerase activity and a D-ribose-5-phosphate aldolase activity, further comprises a deleted or diminished activity in an endogenous 6-phosphofructokinase enzyme. In some embodiments, the endogenous 6-phosphofructokinase enzyme is pfkA and/or pfkB.

In some embodiments, the one or more pentose and/or hexose sugars comprise D-xylose and the recombinant microorganism further comprises expression of at least one enzyme having xylose isomerase activity and expression of at least one enzyme having xylulose 5-kinase activity. In some embodiments, the at least one enzyme having xylose isomerase activity is encoded by an amino acid sequence having at least 70% sequence identity, at least 80% sequence identity, or at least 90% sequence identity to xylA from *E. coli* or *Pyromyces* sp. In a preferred embodiment, an enzyme having xylose isomerase activity is selected from *E. coli* xylA and *Pyromyces* sp xylA. In yet another embodiment, the one or more nucleic acid molecules encoding the xylose isomerase comprises an amino acid sequence selected from SEQ ID NOs: 95 and 144. In a further embodiment, the one or more nucleic acid molecules encoding the xylose isomerase is encoded by a nucleic acid sequence selected from the group consisting of SEQ ID NOs: 93, 94 and 143. In some embodiments, the at least one enzyme having xylulose 5-kinase activity is encoded by an amino acid sequence having at least 70% sequence identity, at least 80% sequence identity, or at least 90% sequence identity to xylB from *E. coli*. In a preferred embodiment, an enzyme having xylulose 5-kinase activity is *E. coli* xylB. In another embodiment, the one or more nucleic acid molecules encoding the D-xylulose 5-kinase comprises an amino acid sequence set forth in SEQ ID NO: 146. In a further embodiment, the one or more nucleic acid molecules encoding the D-xylulose 5-kinase is encoded by a nucleic acid sequence set forth in SEQ ID NO: 145.

In some embodiments, the one or more pentose and/or hexose sugars comprise D-fructose and the recombinant microorganism further comprises expression of at least one enzyme having fructose 1,6-bisphosphatase activity. In one embodiment, the at least one enzyme having fructose 1,6-bisphosphatase activity is encoded by an amino acid sequence having at least 70% sequence identity, at least 80% sequence identity, or at least 90% sequence identity to fbp from E. coli. In a preferred embodiment, an enzyme having fructose 1,6-bisphosphatase activity is E. coli fbp. In some embodiments, the enzyme having fructose 1,6-bisphosphatase activity converts D-fructose 1,6-bisphosphate to D-fructose 6-phosphate. In other embodiments, D-fructose is converted to fructose 1,6-bisphoshate by endogenous enzymes in the recombinant microorganism.

In some embodiments of any of the recombinant microorganisms described above, the recombinant microorganism further comprises a deleted or diminished activity in one or more endogenous enzymes selected from glucose 6-phosphate-1-dehydrogenase, 6-phosphogluconolactonase, and 6-phosphogluconate dehydrogenase. In further embodiments, the glucose 6-phosphate-1-dehydrogenase is zwf, the 6-phosphogluconolactonase is pgl, and the 6-phosphogluconate dehydrogenase is gnd.

In some embodiments, the one or more pentose and/or hexose sugars are capable of being converted to one or more intermediate in the non-oxidative pentose phosphate pathway of the recombinant microorganism. In other embodiments, the one or more pentose and/or hexose sugars are comprised of monomers, oligomers, or a combination thereof.

In some embodiments, the expression of at least one enzyme having transketolase activity and/or fructose-6-phosphate phosphoketolase activity and the expression of at least one enzyme having D-ribose 5-phosphate aldolase activity enables a lossless conversion of one or more pentose and/or hexose sugars to D-ribose-5-phosphate intermediate and the subsequent conversion of D-ribose-5-phosphate to G3P and glycolaldehyde.

In some embodiments, the recombinant microorganism produces MEG or glycolic acid (GA) through the conversion of glycolaldehyde in a C2 pathway and through the conversion of G3P in one or more C3 pathways. In some embodiments, MEG is produced by the reduction of glycolaldehyde by an enzyme having glycolaldehyde reductase activity in a C2 pathway. In other embodiments, GA is produced by the oxidation of glycolaldehyde by an enzyme having glycolaldehyde dehydrogenase activity in a C2 pathway.

In some embodiments, the at least one enzyme for the production of MEG or GA are selected from at least one enzyme having an activity selected from a 3-phosphoglycerate dehydrogenase activity, a phosphoserine aminotransferase activity, a serine transaminase activity, a 3-phosphohydroxypyruvate phosphatase activity, a phosphoserine phosphatase activity, a hydroxypyruvate decarboxylase activity, a 3-phosphohydroxypyruvate reductase activity, a glycolaldehyde reductase activity, a glycolaldehyde dehydrogenase activity, a serine oxidoreductase (deaminating) or serine-pyruvate aminotransferase activity, a serine decarboxylase activity, an ethanolamine aminotransferase or ethanolamine oxidoreductase (deaminating) activity, a glycerate decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, and a glyoxylate reductase activity.

In some embodiments, the recombinant microorganism produces MEG through the conversion of glycolaldehyde in a C2 pathway and produces one or more co-product through the conversion of G3P in one or more C3 pathways. In other embodiments, the one or more co-product is selected from acetone, isopropanol, propene, isobutene and one or more serine pathway compounds. In some preferred embodiments, the one or more serine pathway compounds is selected from serine, glycine, monoethanolamine (MEA) and ethylenediamine (EDA).

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, and an acetoacetate decarboxylase activity, and the one or more co-product comprises acetone.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, and a secondary alcohol dehydrogenase activity, and the one or more co-product comprises isopropanol.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a secondary alcohol dehydrogenase activity, and a dehydratase activity, and the one or more co-product comprises propene.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a 3-hydroxyisovalerate (3HIV) synthase activity, a hydroxymethylglutaryl-CoA synthase activity, a methylglutaconyl-CoA hydratase activity, a methylcrotonyl-CoA carboxylase activity, a methylcrotonyl-CoA hydratase activity, a 3-hydroxyisovaleryl-CoA thioesterase activity, a 3HIV kinase activity, a 3HIV-3-phosphate decarboxylase activity, and a 3HIV decarboxylase activity, and the one or more co-product comprises isobutene.

In some embodiments, the at least one enzyme for the production of one or more co-product through the conversion of G3P in one or more C3 pathways are selected from at least one enzyme having an activity selected from a 3-phosphoglycerate dehydrogenase activity, a phosphoserine aminotransferase activity, a 3-phosphohydroxypyruvate phosphatase activity, a phosphoserine phosphatase activity, a serine oxidoreductase (deaminating) or serine-pyruvate aminotransferase activity, a hydroxypyruvate reductase activity, a 3-phosphoglycerate phosphatase activity, a 2-phosphoglycerate phosphatase activity, a glycerate 3-kinase activity, and a glycerate 2-kinase activity, and the one or more co-product comprises L-serine.

In some embodiments, the at least one enzyme for the production of one or more co-product through the conversion of G3P in one or more C3 pathways are selected from at least one enzyme having an activity selected from a serine hydroxymethyltransferase activity, a transferase activity, a formaldehyde dehydrogenase activity, a formate dehydrogenase activity, an activity associated with glycine cleavage system, a 3-phosphoglycerate dehydrogenase activity, a phosphoserine aminotransferase activity, a 3-phosphohydroxypyruvate phosphatase activity, a phosphoserine phosphatase activity, a serine transaminase activity, a hydroxypyruvate decarboxylase activity, a serine oxidoreductase (deaminating) activity, a serine decarboxylase activity, an ethanolamine aminotransferase or ethanolamine oxidoreductase (deaminating) activity, a hydroxypyruvate reductase activity, a 3-phosphoglycerate phosphatase activity, a 2-phosphoglycerate phosphatase activity, a glycerate 3-kinase activity, a glycerate 2-kinase activity, a glycolaldehyde dehydrogenase activity, a glycolate dehydrogenase activity, an alanine-glyoxylate aminotransferase activity, an alanine transaminase activity, an NAD(P)H dependent glutamate dehydrogenase activity, and the one or more co-product comprises glycine. In another embodiment, the activity associated with glycine cleavage system comprise an enzyme or protein selected from a glycine decarboxylase (P protein), an aminomethyltransferase (T protein), a dihydrolipoamide dehydrogenase (L protein), and an H protein.

In some embodiments, the at least one enzyme for the production of one or more co-product through the conversion of G3P in one or more C3 pathways are selected from at least one enzyme having an activity selected from a 3-phosphoglycerate dehydrogenase activity, a 3-phosphoserine aminotransferase activity, a 3-phosphohydroxypyruvate phosphatase activity, a phosphoserine phosphatase activity, a transaminase activity, a hydroxypyruvate decarboxylase activity, a serine oxidoreductase (deaminating) or serine-pyruvate aminotransferase activity, a serine decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, an acetaldehyde dehydrogenase activity, and an ethanolamine ammonia lyase activity, and the one or more co-product comprises monoethanolamine (MEA).

In some embodiments, the at least one enzyme for the production of one or more co-product through the conversion of G3P in one or more C3 pathways are selected from at least one enzyme having an activity selected from a serine dehydrogenase activity, a 2-aminomalonate semialdehyde decarboxylase activity, an aminoacetaldehyde transaminase activity, a 2-aminomalonate semialdehyde transaminase activity, a 2,3-diaminopropanoate decarboxylase activity, a serine decarboxylase activity, an ethanolamine dehydrogenase activity, a serine hydroxymethyltransferase activity, an aldehyde oxidase activity, an N-acetyl transferase or O-acetyl transferase activity, an N-acetylserine dehydrogenase activity, a transaminase activity, a deacetylase activity, a serine aminase activity, and a 2,3-diaminopropanoate ammonia lyase activity, and the one or more co-product comprises ethylenediamine (EDA).

In some embodiments of any of the recombinant microorganisms described above, the recombinant microorganism further comprises one or more modifications to diminish or delete activity in a glycolaldehyde reductase, a glycolaldehyde dehydrogenase, a lactate dehydrogenase, or combination thereof.

In one embodiment, at least a portion of the excess NADH produced in the C3 pathway is used as a source of reducing equivalents in the C2 pathway. In another embodiment, at least a portion of the excess NADH produced in the C3 pathway is used to produce ATP.

In one embodiment, excess biomass formation is minimized and production of MEG or glycolic acid or MEG and one or more co-products is maximized.

Pentose and/or Hexose Sugars to D-Ribose 5-Phosphate Intermediate and Subsequent Conversion of D-Ribose 5-Phosphate Intermediate to Glycolaldehyde and D-Glyceraldehyde 3-Phosphate In the present disclosure, pentose and/or hexose sugars are converted into a pentose-phosphate intermediate, an intermediate of the non-oxidative pentose phosphate pathway. The pentose-phosphate intermediate, D-ribose-5-phosphate, D-ribulose-5-phosphate or D-xylulose-5-phosphate, then serves as a substrate for a D-pentose-phosphate aldolase, having D-ribose-5-phosphate aldolase activity, D-ribulose-5-phosphate aldolase activity, or D-xylulose-5-phosphate aldolase activity, to produce glycolaldehyde and D-glyceraldehyde 3-phosphate, compounds which can then be further converted to MEG or GA, or MEG and one or more co-products.

In the present disclosure, pentose and/or hexose sugars are converted into D-ribose 5-phosphate, an intermediate of the non-oxidative pentose phosphate pathway. The D-ribose 5-phosphate intermediate then serves as a substrate for a D-ribose 5-phosphate aldolase to produce glycolaldehyde and D-glyceraldehyde 3-phosphate, compounds which can then be further converted to MEG or GA, or MEG and one or more co-products.

[A] Therefore, in one embodiment, the application relates to a recombinant microorganism capable of producing glycolaldehyde and D-glyceraldehyde 3-phosphate (G3P) via a pentose-phosphate intermediate from one or more pentose and/or hexose sugars, wherein the recombinant microorganism expresses one or more of the following from (a) to (h):

(a) at least one endogenous or exogenous nucleic acid molecule encoding an enzyme having transketolase activity that catalyzes a reversible conversion of D-fructose-6-phosphate and D-glyceraldehyde-3-phosphate to D-erythrose-4-phosphate and D-xylulose-5-phosphate, respectively, and/or that catalyzes a reversible conversion of D-glyceraldehyde-3-phosphate from (b) and D-seduheptulose-7-phosphate from (b) to pentose-phosphate and D-xylulose-5-phosphate, respectively;

(b) at least one endogenous or exogenous nucleic acid molecule encoding an enzyme having transaldolase activity that catalyzes a reversible conversion of D-fructose-6-phosphate and D-erythrose-4-phosphate from (a) to D-glyceraldehyde-3-phosphate and D-seduheptulose-7-phosphate, respectively;

(c) at least one endogenous or exogenous nucleic acid molecule encoding an enzyme having ribulose-5-phosphate 3-epimerase activity that catalyzes an interconversion of D-xylulose-5-phosphate from (a) and/or (f) and D-ribulose-5-phosphate;

(d) at least one endogenous or exogenous nucleic acid molecule encoding an enzyme having ribose-5-phosphate isomerase activity that catalyzes an interconversion of D-ribulose-5-phosphate from (c) and D-ribose-5-phosphate;

(e) at least one endogenous or exogenous nucleic acid molecule encoding an enzyme having xylose isomerase activity that catalyzes the conversion of D-xylose to D-xylulose;

(f) at least one endogenous or exogenous nucleic acid molecule encoding an enzyme having xylulose 5-kinase activity that catalyzes the conversion of D-xylulose to D-xylulose-5-phosphate;

(g) at least one endogenous or exogenous nucleic acid molecule encoding an enzyme having fructose 1,6-bisphosphatase activity that catalyzes the conversion of D-fructose 1,6-bisphosphate to D-fructose 6-phosphate;

(h) at least one endogenous or exogenous nucleic acid molecule encoding an enzyme having pentose-5-phosphate aldolase activity that catalyzes the conversion of pentose-5-phosphate from (a) and/or (d) to glycolaldehyde and D-glyceraldehyde-3-phosphate;

wherein the recombinant microorganism optionally further comprises a deletion, insertion, or loss of function mutation in a gene encoding a glyceraldehyde 3-phosphate dehydrogenase, and/or a phosphoglycerate kinase and/or a phosphoglycerate mutase;

wherein the one or more pentose and/or hexose sugars are capable of being converted to one or more intermediate in the non-oxidative pentose phosphate pathway of the recombinant microorganism, and wherein glycolaldehyde and D-glyceraldehyde 3-phosphate (G3P) are produced.

[B] Therefore, in one embodiment, the application relates to a recombinant microorganism capable of producing glycolaldehyde and D-glyceraldehyde 3-phosphate (G3P) via a D-ribose 5-phosphate, ribulose 5-phosphate, or xylulose 5-phosphate intermediate from one or more pentose and/or hexose sugars, wherein the recombinant microorganism expresses one or more of the following from (a) to (h):

(a) at least one endogenous or exogenous nucleic acid molecule encoding an enzyme having transketolase activity that catalyzes a reversible conversion of D-fructose-6-phosphate and D-glyceraldehyde-3-phosphate to D-erythrose-4-phosphate and D-xylulose-5-phosphate, respectively, and/or that catalyzes a reversible conversion of D-glyceraldehyde-3-phosphate from (b) and D-seduheptulose-7-phosphate from (b) to D-ribose-5-phosphate and D-xylulose-5-phosphate, respectively;

(b) at least one endogenous or exogenous nucleic acid molecule encoding an enzyme having transaldolase activity that catalyzes a reversible conversion of D-fructose-6-phosphate and D-erythrose-4-phosphate from (a) to D-glyceraldehyde-3-phosphate and D-seduheptulose-7-phosphate, respectively;

(c) at least one endogenous or exogenous nucleic acid molecule encoding an enzyme having ribulose-5-phosphate 3-epimerase activity that catalyzes an interconversion of D-xylulose-5-phosphate from (a) and/or (f) and D-ribulose-5-phosphate;

(d) at least one endogenous or exogenous nucleic acid molecule encoding an enzyme having ribose-5-phosphate isomerase activity that catalyzes an interconversion of D-ribulose-5-phosphate from (c) and D-ribose-5-phosphate;

(e) at least one endogenous or exogenous nucleic acid molecule encoding an enzyme having xylose isomerase activity that catalyzes the conversion of D-xylose to D-xylulose;

(f) at least one endogenous or exogenous nucleic acid molecule encoding an enzyme having xylulose 5-kinase activity that catalyzes the conversion of D-xylulose to D-xylulose-5-phosphate;

(g) at least one endogenous or exogenous nucleic acid molecule encoding an enzyme having fructose 1,6-bisphosphatase activity that catalyzes the conversion of D-fructose 1,6-bisphosphate to D-fructose 6-phosphate;

(h) at least one endogenous or exogenous nucleic acid molecule encoding an enzyme having D-ribose 5-phosphate, ribulose 5-phosphate, or xylulose 5-phosphate aldolase activity that catalyzes the conversion of D-ribose-5-phosphate, ribulose 5-phosphate, or xylulose 5-phosphate from (a) and/or (d) to glycolaldehyde and D-glyceraldehyde-3-phosphate;

wherein the recombinant microorganism optionally further comprises a deletion, insertion, or loss of function mutation in a gene encoding a glyceraldehyde 3-phosphate dehydrogenase, and/or a phosphoglycerate kinase and/or a phosphoglycerate mutase;

wherein the one or more pentose and/or hexose sugars are capable of being converted to one or more intermediate in the non-oxidative pentose phosphate pathway of the recombinant microorganism, and wherein glycolaldehyde and D-glyceraldehyde 3-phosphate (G3P) are produced.

[C] In another embodiment, the application relates to a recombinant microorganism capable of producing glycolaldehyde and D-glyceraldehyde 3-phosphate (G3P) via a D-ribose 5-phosphate intermediate from one or more pentose and/or hexose sugars, wherein the recombinant microorganism expresses one or more of the following from (a) to (j):

(a) at least one endogenous or exogenous nucleic acid molecule encoding an enzyme having fructose-6-phosphate phosphoketolase activity that catalyzes a reversible conversion of D-fructose-6-phosphate to D-erythrose-4-phosphate and acetyl-phosphate;

(b) at least one endogenous or exogenous nucleic acid molecule encoding an enzyme having phosphate acetyltransferase activity that catalyzes a reversible conversion of acetyl-phosphate from (a) to acetyl-CoA;

(c) at least one endogenous or exogenous nucleic acid molecule encoding an enzyme having transaldolase activity that catalyzes a reversible conversion of D-fructose-6-phosphate and D-erythrose-4-phosphate from (a) to D-glyceraldehyde-3-phosphate and D-seduheptulose-7-phosphate, respectively;

(d) at least one endogenous or exogenous nucleic acid molecule encoding an enzyme having transketolase activity that catalyzes a reversible conversion of D-glyceraldehyde-3-phosphate from (c) and D-seduheptulose-7-phosphate from (c) to D-ribose-5-phosphate and D-xylulose-5-phosphate, respectively;

(e) at least one endogenous or exogenous nucleic acid molecule encoding an enzyme having ribulose-5-phosphate 3-epimerase activity that catalyzes an interconversion of D-xylulose-5-phosphate from (d) and/or (h) and D-ribulose-5-phosphate;

(f) at least one endogenous or exogenous nucleic acid molecule encoding an enzyme having ribose-5-phosphate isomerase activity that catalyzes an interconversion of D-ribulose-5-phosphate from (e) and D-ribose-5-phosphate;

(g) at least one endogenous or exogenous nucleic acid molecule encoding an enzyme having xylose isomerase activity that catalyzes the conversion of D-xylose to D-xylulose;

(h) at least one endogenous or exogenous nucleic acid molecule encoding an enzyme having xylulose 5-kinase activity that catalyzes the conversion of D-xylulose to D-xylulose-5-phosphate;

(i) at least one endogenous or exogenous nucleic acid molecule encoding an enzyme having fructose 1,6-bisphosphatase activity that catalyzes the conversion of D-fructose 1,6-bisphosphate to D-fructose 6-phosphate;

(j) at least one endogenous or exogenous nucleic acid molecule encoding an enzyme having D-ribose 5-phosphate aldolase activity that catalyzes the conversion of D-ribose-5-phosphate from (d) and/or (f) to glycolaldehyde and D-glyceraldehyde-3-phosphate;

wherein the recombinant microorganism optionally further comprises a deletion, insertion, or loss of function mutation in a gene encoding a 6-phosphofructokinase;

wherein the one or more pentose and/or hexose sugars are capable of being converted to one or more intermediate in the non-oxidative pentose phosphate pathway of the recombinant microorganism, wherein the acetyl-CoA produced in step (b) can be used to produce one or more co-products selected from glycolic acid, acetone, isopropanol, propene, isobutene, and one or more serine pathway compounds;

and wherein glycolaldehyde and D-glyceraldehyde 3-phosphate (G3P) are produced.

In some embodiments, the oxidative branch of the pentose phosphate pathway is deleted or inactivated to optimize flux of sugars towards the non-oxidative entry into the pentose phosphate pathway.

[D] Therefore, in one embodiment, the recombinant microorganism of embodiment [A], embodiment [B] or embodiment [C] optionally further comprises one or more modifications selected from the group consisting of:

(i) a deletion, insertion, or loss of function mutation in a gene encoding a glucose 6-phosphate-1-dehydrogenase that catalyzes the conversion of glucose-6-phosphate to 6-phospho-D-glucono-1,5-lactone;

(ii) a deletion, insertion, or loss of function mutation in a gene encoding a 6-phosphogluconolactonase that catalyzes the conversion of 6-phospho-D-glucono-1,5-lactone to gluconate-6-phosphate; and (iii) a deletion, insertion, or loss of function mutation in a gene encoding a 6-phosphogluconate dehydrogenase that catalyzes the conversion of gluconate-6-phosphate to D-ribulose-5-phosphate.

In some embodiments, the enzyme having transketolase activity is encoded by an amino acid sequence having at least 70% sequence identity, having at least 80% sequence identity, or having at least 90% sequence identity to *E. coli* tktA. In other embodiments, the transketolase is encoded by an amino acid sequence having at least 70% sequence identity, having at least 80% sequence identity, or having at least 90% sequence identity to *E. coli* tktB. In some embodiments, the transketolase is *E. coli* tktA. In other embodiments, the transketolase is *E. coli* tktB.

In some embodiments, the one or more nucleic acid molecules encoding the enzyme having transketolase activity is tktA, or homolog thereof. In some embodiments, the one or more nucleic acid molecules encoding the enzyme having transketolase activity is tktB, or homolog thereof. In another embodiment, the one or more nucleic acid molecules encoding the enzyme having transketolase activity comprises an amino acid sequence selected from the group consisting of SEQ ID NOs: 148 and 150. In a further embodiment, the one or more nucleic acid molecule encoding the enzyme having transketolase activity is encoded by a nucleic acid sequence selected from the group consisting of SEQ ID NOs: 147 and 149.

In some embodiments, the enzyme having transaldolase activity is encoded by an amino acid sequence having at least 70% sequence identity, at least 80% sequence identity, or at least 90% sequence identity to talA or talB from *E. coli*. In some embodiments, the enzyme having transaldolase activity is talA from *E. coli*. In other embodiments, the enzyme having transaldolase activity is talB from *E. coli*. In another embodiment, the one or more nucleic acid molecules encoding the enzyme having transaldolase activity comprises an amino acid sequence selected from the group consisting of SEQ ID NOs: 152 and 154. In a further embodiment, the one or more nucleic acid molecule encoding the enzyme having transaldolase activity is encoded by a nucleic acid sequence selected from the group consisting of SEQ ID NOs: 151 and 153.

In one embodiment, the enzyme having ribose-5-phosphate isomerase activity is encoded by an amino acid sequence having at least 70% sequence identity, having at least 80% sequence identity, or having at least 90% sequence identity to *E. coli* rpiA or rpiB. In some embodiments, the enzyme having ribose-5-phosphate isomerase activity is *E. coli* rpiA. In some embodiments, the enzyme having ribose-5-phosphate isomerase activity is *E. coli* rpiB.

In some embodiments, the one or more nucleic acid molecules encoding the enzyme having ribose-5-phosphate isomerase activity is rpiA, or homolog thereof. In another embodiment, the one or more nucleic acid molecules encoding an enzyme having ribose-5-phosphate isomerase activity comprise an amino acid sequence set forth in SEQ ID NO: 156. In a further embodiment, the one or more nucleic acid molecules encoding an enzyme having ribose-5-phosphate isomerase activity is encoded by a nucleic acid sequence set forth in SEQ ID NO: 155. In some embodiments, the one or more nucleic acid molecules encoding the enzyme having ribose-5-phosphate isomerase activity is rpiB, or homolog thereof. In another embodiment, the one or more nucleic acid molecules encoding an enzyme having ribose-5-phosphate isomerase activity comprise an amino acid sequence set forth in SEQ ID NO: 254. In a further embodiment, the one or more nucleic acid molecules encoding an enzyme having ribose-5-phosphate isomerase activity is encoded by a nucleic acid sequence set forth in SEQ ID NO: 253.

In one embodiment, the enzyme having ribulose-5-phosphate 3-epimerase activity is encoded by an amino acid sequence having at least 70% sequence identity, having at least 80% sequence identity, or having at least 90% sequence identity to *E. coli* rpe. In some embodiments, the enzyme having ribulose-5-phosphate 3-epimerase activity is *E. coli* rpe.

In some embodiments, the one or more nucleic acid molecules encoding the enzyme having ribulose-5-phosphate 3-epimerase activity is rpe, or homolog thereof. In another embodiment, the one or more nucleic acid molecules encoding the enzyme having ribulose-5-phosphate 3-epimerase activity comprise an amino acid sequence set forth in SEQ ID NO: 158. In a further embodiment, the one or more nucleic acid molecule encoding the enzyme having ribulose-5-phosphate 3-epimerase activity is encoded by a nucleic acid sequence set forth in SEQ ID NO: 157.

In one embodiment, the enzyme having fructose-6-phosphate phosphoketolase activity is encoded by an amino acid sequence having at least 70% sequence identity, at least 80% sequence identity, or at least 90% sequence identity to an enzyme having fructose-6-phosphate phosphoketolase activity selected from the group consisting of *Bifidobacterium dentium* BDP_1006, *Bifidobacterium lactis* xfp, *Lactobacillus paraplantarum* xpkA and *Bifidobacterium breve* xfp. In other embodiments, the enzyme having fructose-6-phosphate phosphoketolase activity is selected from the group consisting of *Bifidobacterium dentium* BDP_1006, *Bifidobacterium lactis* xfp, *Lactobacillus paraplantarum* xpkA and *Bifidobacterium breve* xfp.

In some embodiments, the one or more nucleic acid molecules encoding the enzyme having fructose-6-phosphate phosphoketolase activity is selected from BDP_1006, xfp, xpkA, or homolog thereof. In another embodiment, the one or more nucleic acid molecules encoding the enzyme having fructose-6-phosphate phosphoketolase activity comprise an amino acid sequence selected from the group consisting of SEQ ID NOs: 212, 214, 216 and 218. In a further embodiment, the one or more nucleic acid molecule encoding the enzyme having fructose-6-phosphate phosphoketolase activity is encoded by a nucleic acid sequence selected from the group consisting of SEQ ID NOs: 211, 213, 215 and 217.

In one embodiment, the enzyme having phosphate acetyltransferase activity is encoded by an amino acid sequence having at least 70% sequence identity, at least 80% sequence identity, or at least 90% sequence identity to an enzyme having phosphate acetyltransferase activity selected from *E. coli* pta and *Clostridium acetobutylicum* pta. In other embodiments, the enzyme having phosphate acetyltransferase activity is selected from *E. coli* pta and *Clostridium acetobutylicum* pta.

In some embodiments, the one or more nucleic acid molecules encoding the enzyme having phosphate acetyltransferase activity is pta, or homolog thereof. In another embodiment, the one or more nucleic acid molecules encoding the enzyme having phosphate acetyltransferase activity comprise an amino acid sequence selected from SEQ ID NOs: 220 and 222. In a further embodiment, the one or more nucleic acid molecule encoding the enzyme having phosphate acetyltransferase activity is encoded by a nucleic acid sequence selected from SEQ ID NOs: 219 and 221.

In some embodiments, the enzyme having pentose-phosphate aldolase activity, including D-ribose-5-phosphate aldolase activity, D-ribulose-5-phosphate aldolase activity, or D-xylulose-5-phosphate aldolase activity, is encoded by an amino acid sequence having at least 70% sequence identity, at least 80% sequence identity, or at least 90% sequence identity to deoC from *E. coli*. In other embodiments, the enzyme having D-ribose-5-phosphate aldolase activity is deoC from *E. coli*.

In some embodiments, the recombinant microorganism comprises an endogenous or exogenous enzyme having xylose isomerase activity that catalyzes the conversion of D-xylose to D-xylulose. In one embodiment, the enzyme having xylose isomerase activity is exogenous. In another embodiment, the enzyme having xylose isomerase activity is encoded by one or more nucleic acid molecules obtained from *Pyromyces* sp. In a further embodiment, the enzyme having xylose isomerase activity is encoded by one or more nucleic acid molecules obtained from *E. coli*. In another embodiment, the one or more nucleic acid molecules encoding the enzyme having xylose isomerase activity is xylA, or homolog thereof. In yet another embodiment, the one or more nucleic acid molecules encoding the enzyme having xylose isomerase activity comprises an amino acid sequence selected from SEQ ID NOs: 95 and 144. In a further embodiment, the one or more nucleic acid molecules encoding the enzyme having xylose isomerase activity comprises a nucleic acid sequence selected from the group consisting of SEQ ID NOs: 93, 94 and 143.

In some embodiments, the enzyme having xylulose 5-kinase activity is encoded by an amino acid sequence having at least 70% sequence identity, at least 80% sequence identity, or at least 90% sequence identity to xylB from *E. coli*. In a preferred embodiment, an enzyme having xylulose 5-kinase activity is *E. coli* xylB. In another embodiment, the one or more nucleic acid molecules encoding the D-xylulose 5-kinase comprises an amino acid sequence set forth in SEQ ID NO: 146. In a further embodiment, the one or more nucleic acid molecules encoding the D-xylulose 5-kinase is encoded by a nucleic acid sequence set forth in SEQ ID NO: 145.

In one embodiment, the enzyme having fructose 1,6-bisphosphatase activity is encoded by an amino acid sequence having at least 70% sequence identity, at least 80% sequence identity, or at least 90% sequence identity to fbp from *E. coli*. In a preferred embodiment, an enzyme having fructose 1,6-bisphosphatase activity is *E. coli* fbp. In some embodiments, the enzyme having fructose 1,6-bisphosphatase activity converts D-fructose 1,6-bisphosphate to D-fructose 6-phosphate. In other embodiments, D-fructose is converted to fructose 1,6-bisphoshate by endogenous enzymes in the recombinant microorganism.

MEG or Glycolic Acid, or MEG and Co-Product Production Pathways

In some embodiments, the glycolaldehyde and glyceraldehyde-3-phosphate intermediates produced from embodiment [A], from embodiment [B] or from embodiment [C] (and optionally comprising embodiment [D]) are used in known MEG (or glycolic acid) C₂ production pathways, which are coupled to C3 pathways, as described below, to co-produce additional MEG (or glycolic acid) and/or one or more co-products.

In some embodiments, MEG is produced via a C2 pathway that uses an enzyme having glycolaldehyde reductase activity to convert glycolaldehyde to MEG. In another embodiment, glycolic acid (GA) is produced via a C2 pathway that uses an enzyme having glycolaldehyde dehydrogenase activity to oxidize glycolaldehyde to GA.

[E] In one embodiment, the application relates to a recombinant microorganism capable of producing monoethylene glycol (MEG) from one or more pentose and/or hexose sugars, wherein the recombinant microorganism from embodiment [A], from embodiment [B], or from embodiment [C] (and optionally comprising embodiment [D]), further expresses: at least one endogenous or exogenous nucleic acid molecule encoding an enzyme having glycolaldehyde reductase activity that catalyzes the conversion of glycolaldehyde to MEG, wherein the recombinant microorganism optionally further comprises a deletion, insertion, or loss of function mutation in a gene encoding a glycolaldehyde dehydrogenase, and wherein MEG is produced.

[F] In one embodiment, the application relates to a recombinant microorganism capable of producing glycolic acid (GA) from one or more pentose and/or hexose sugars, wherein the recombinant microorganism from embodiment [A], from embodiment [B], or from embodiment [C] (and optionally comprising embodiment [D]), further expresses: at least one endogenous or exogenous nucleic acid molecule encoding an enzyme having glycolaldehyde dehydrogenase activity that catalyzes the conversion of glycolaldehyde to GA, wherein the recombinant microorganism optionally further comprises a deletion, insertion, or loss of function mutation in a gene encoding a glycolaldehyde reductase, and wherein GA is produced.

In some embodiments, the enzyme having glycolaldehyde reductase activity is encoded by one or more nucleic acid molecules obtained from a microorganism selected from *E. coli* and *S. cerevisiae*. In another embodiment, the one or more nucleic acid molecules is selected from gldA, GRE2, GRE3, yqhD, ydjG, fucO, yafB (dkgB), and/or yqhE (dkgA), or homolog thereof. In another embodiment, the one or more nucleic acid molecules is yqhD. In some embodiments, the yqhD comprises a G149E mutation. In a further embodiment, the enzyme having glycolaldehyde reductase activity comprises an amino acid sequence selected from the group consisting of SEQ ID NOs: 13, 15, 17, 20, 23, 25, 28, 30 and 32. In yet a further embodiment, the enzyme having glycolaldehyde reductase activity is encoded by a nucleic acid sequence selected from the group consisting of SEQ ID NOs: 12, 14, 16, 18, 19, 21, 22, 24, 26, 27, 29 and 31.

In one embodiment, the enzyme having glycolaldehyde dehydrogenase activity is encoded by an amino acid sequence having at least 70% sequence identity, at least 80% sequence identity, or at least 90% sequence identity to aldA from *E. coli* (SEQ ID NO: 289). In a preferred embodiment, an enzyme having glycolaldehyde dehydrogenase activity is *E. coli* aldA.

Production of MEG (or Glycolic Acid) Via a C2 Pathway and MEG (or Glycolic Acid) Via a C3 Pathway In one aspect, MEG (or glycolic acid) is produced from one or more pentose and/or hexose sugars by the lossless transformation of the one or more pentose and/or hexose sugars to D-ribose-5-phosphate intermediate, followed by a conversion of the pentose-phosphate intermediate to glycolaldehyde and G3P intermediates, followed by a conversion of the glycolaldehyde intermediate to MEG (or glycolic acid) via a C2 pathway, and a conversion of G3P to MEG (or glycolic acid) via a C3 pathway. Wherein the pentosephosphate intermediate is D-ribose-5-phosphate, D-ribulose-5-phosphate or D-xylulose-5-phosphate.

In some embodiments, the application relates to a recombinant microorganism capable of producing MEG (or glycolic acid) from one or more pentose and/or hexose sugars, wherein the recombinant microorganism from embodiment [A], from embodiment [B] or from embodiment [C] (and optionally comprising embodiment [D]), and having additionally embodiment [E] or embodiment [F] for production of MEG (or glycolic acid) in a C2 pathway, further comprises one or more C3 biosynthesis pathway for the production of MEG (or glycolic acid). The C3 biosynthesis pathways for the production of MEG are, for example, as described in WO 2010/076324 (Metabolic Explorer), herein incorporated by reference in its entirety.

In some embodiments, the C3 biosynthesis pathway for the production of MEG comprises three enzymatic reactions starting with transformation of the 3-phosphohydroxypyruvate precursor (precursor for serine). First, a phosphatase activity allows conversion of phosphohydroxypyruvate into hydroxypyruvate. Hydroxypyruvate is then transformed into glycolaldehyde with a 2-keto acid decarboxylase activity. Finally, a hydroxy aldehyde reductase activity allows the conversion of glycolaldehyde into ethylene glycol. Another pathway for the production of ethylene glycol starts from L-serine as precursor. First a transaminase or an amino acid oxidase activity allows conversion of serine into hydroxypyruvate. The next two steps to convert hydroxypyruvate into glycolaldehyde and then to MEG are similar to the first pathway described above.

In a preferred embodiment, the disclosure provides for a recombinant microorganism comprising one or more C3 biosynthesis pathways for production of MEG. In some embodiments, the recombinant microorganism, particularly a bacterium, contains at least one gene encoding a polypeptide with 2-keto acid decarboxylase activity and one gene encoding a polypeptide with hydroxy aldehyde reductase activity. These genes can be exogenous or endogenous, and can be expressed chromosomally or extrachromosomally.

In a further embodiment of the disclosure, the recombinant microorganism, particularly a bacterium, comprises modifications in which the availability of the intermediate 3-phosphoglycerate is increased. Preferably, the increase is achieved by attenuating the level of expression of genes encoding phosphoglycerate mutases, in particular one or both genes gpmA and pgmI. This can be done by replacing the wild-type promoter of these genes by a weaker promoter, or by the use of an element destabilizing the corresponding messenger RNA or the protein. If needed, complete attenuation of the genes can also be achieved by the deletion of the corresponding DNA sequences.

In another embodiment, the recombinant microorganism, particularly a bacterium, comprises modifications in which flux into the serine biosynthesis pathway is stimulated. This can be achieved by increasing the level of expression of 3-phosphoglycerate dehydrogenase and/or phosphoserine aminotransferase, encoded by the serA and serC genes, respectively. Increasing the level of expression of the 3-phosphoglycerate dehydrogenase and/or phosphoserine aminotransferase can be accomplished by introducing artificial promoters that drive the expression of the serA and/or serC genes, by increasing the number of copies in the cell or by introducing mutations into the serA and/or serC genes that increase the activity of the corresponding proteins. The expression of the serA gene can also be increased by replacing the wild type lrp gene (encoding the leucine-responsive regulatory protein) by an lrp mutated allele (such as the lrp-1 allele corresponding to a GLU 114 ASP substitution in the lrp protein) leading to the constitutive activation of the transcription of the serA gene.

In a particular embodiment of the disclosure mutations can be introduced into the serA gene that reduce the sensitivity of the SerA protein to the feed-back inhibitor serine (feed-back desensitized alleles) and thus permit an increased activity in the presence of serine. Examples of desensitized alleles, i.e. feed-back insensitive alleles, have been described in EP 0 931 833 (Ajinomoto) or EP 0 620 853 (Wacker).

In another embodiment, the recombinant microorganism, particularly a bacterium, comprises modifications in which flux into the hydroxypyruvate biosynthesis pathway is stimulated. This result can be achieved by increasing the level of expression of serine transaminase or serine oxidase (for the pathway starting from serine as precursor), or by increasing the expression of 3-phosphohydroxypyruvate phosphatase. Increasing the level of expression of serine oxidase can be accomplished by introducing and overexpressing the gene coding for L-amino acid oxidase from *R. opacus*, or by introducing mutations into the gene that increase the activity of the corresponding protein. An increase in the expression of serine transaminase can be accomplished by introducing artificial promoters that drive the expression of the serC gene of *E. coli*, by increasing the number of copies in the cell or by introducing mutations into the serC gene that increase the activity of the corresponding protein. An increase of the expression of 3-phosphohydroxypyruvate phosphatase can be accomplished by introducing artificial promoters that drive the expression of the yeaB gene or serB gene of *E. coli*, by increasing the number of copies in the cell or by introducing mutations into the yeaB gene or the serB gene that increase the activity of the corresponding proteins. An increase of the expression of 3-phosphohydroxypyruvate phosphatase can also be accomplished by introducing and overexpressing the gene GPP2 from *S. cerevisiae*, or by introducing mutations into the GPP2 gene that increase the activity of the corresponding protein.

In a further embodiment of the disclosure, the recombinant microorganism, particularly a bacterium, comprises modifications to present an attenuated level of glycolaldehyde conversion to other compounds than ethylene glycol This may be achieved by attenuating the level of glycolaldehyde consuming enzymes like hydroxythreonine aldolase (encoded by UaE) or glycolaldehyde dehydrogenase (encoded by aldA, aldB). Attenuation of these genes can be done by replacing the natural promoter by a lower strength promoter or by elements destabilizing the corresponding messenger RNA or the protein. If needed, complete attenuation of the gene can also be achieved by a deletion of the corresponding DNA sequence.

In a further embodiment of the disclosure, the efficiency of sugar import is increased, either by using a sugar import system not relying on phosphoenolpyruvate (PEP) as phosphordonor like galP that is known to transport glucose, or by providing more phosphoenolpyruvate (PEP) to the sugar-phosphotransferase system. Various means exist that may be used to increase the availability of PEP in a microorganism. In particular, this can be accomplished by attenuating the reaction PEP→pyruvate. Preferentially, at least one gene selected among pykA and pykF, encoding pyruvate kinase, is attenuated in said strain in order to obtain this result. Another way to increase the availability of PEP is to favour the reaction pyruvate→PEP. This can be accomplished by increasing the activity of phosphoenolpyruvate synthase which catalyzes the above reaction. This enzyme is encoded by the ppsA gene. Therefore, in the microorganism, the expression of the ppsA gene is preferentially increased. Both modifications can be present in the microorganism simultaneously.

In a further embodiment of the disclosure, the recombinant microorganism, particularly a bacterium, comprises modifications to present an attenuated level of serine conversion to other compounds than ethylene glycol. This result may be achieved by attenuating the level of serine consuming enzymes like serine deaminases (encoded by sdaA, sdaB and/or tdcG), serine transacetylase (encoded by cysE), tryptophan synthase (encoded by trpAB) or serine hydroxymethyltransferase (encoded by glyA). These genes can be attenuated by replacing the natural promoter by a lower strength promoter or by elements destabilizing the corresponding messenger RNA or the protein. If needed, complete attenuation of the gene can also be achieved by a deletion of the corresponding DNA sequence.

In a further embodiment of the disclosure, the recombinant microorganism, particularly a bacterium, comprises modifications to present an attenuated level of hydroxypyruvate conversion to other compounds than glycolaldehyde. This result may be achieved by attenuating the level of hydroxypyruvate consuming enzymes like hydroxypyruvate reductase (encoded by ghrA) or hydroxypyruvate isomerase (encoded by hyi). These genes can be attenuated by replacing the natural promoter by a lower strength promoter or by elements destabilizing the corresponding messenger RNA or the protein. If needed, complete attenuation of the gene can also be achieved by a deletion of the corresponding DNA sequence.

In some embodiments, the application relates to a recombinant microorganism capable of producing MEG (or glycolic acid) from one or more pentose and/or hexose sugars, wherein the recombinant microorganism from embodiment [A], from embodiment [B], or from embodiment [C] (and optionally comprising embodiment [D]), and having additionally embodiment [E] or embodiment [F] for production of MEG (or glycolic acid) in a C2 pathway, further comprises one or more C3 biosynthesis pathway for the production of MEG (or glycolic acid). The C3 biosynthesis pathways for the production of MEG are, for example, as described in as described in WO 2011/130378 (Genomatica), herein incorporated by reference in its entirety.

In some embodiments, the disclosure provides a recombinant microorganism comprising an ethylene glycol pathway having at least one exogenous nucleic acid encoding an ethylene glycol pathway enzyme expressed in a sufficient amount to produce ethylene glycol, the ethylene glycol pathway including a serine aminotransferase, a serine oxidoreductase (deaminating), a hydroxypyruvate decarboxylase, a glycolaldehyde reductase, a serine decarboxylase, an ethanolamine aminotransferase, an ethanolamine oxidoreductase (deaminating), a hydroxypyruvate reductase or a glycerate decarboxylase.

In some embodiments, the recombinant microorganism comprises an ethylene glycol pathway having at least one exogenous nucleic acid encoding ethylene glycol pathway enzymes expressed in a sufficient amount to produce ethylene glycol, the ethylene glycol pathway including a serine aminotransferase or a serine oxidoreductase (deaminating); a hydroxypyruvate decarboxylase, and a glycolaldehyde reductase.

In some embodiments, the recombinant microorganism comprises an ethylene glycol pathway having at least one exogenous nucleic acid encoding ethylene glycol pathway enzymes expressed in a sufficient amount to produce ethylene glycol, the ethylene glycol pathway including a serine aminotransferase or a serine oxidoreductase (deaminating); a hydroxypyruvate reductase, and a glycerate decarboxylase.

In some embodiments, the recombinant microorganism comprises an ethylene glycol pathway having at least one exogenous nucleic acid encoding ethylene glycol pathway enzymes expressed in a sufficient amount to produce ethylene glycol, the ethylene glycol pathway including a serine decarboxylase; an ethanolamine aminotransferase or an ethanolamine oxidoreductase (deaminating), and a glycolaldehyde reductase.

In some embodiments, the disclosure provides a recombinant microorganism comprising an ethylene glycol pathway having at least one exogenous nucleic acid encoding an ethylene glycol pathway enzyme expressed in a sufficient amount to produce ethylene glycol, the ethylene glycol pathway including a hydroxypyruvate decarboxylase, glycolaldehyde reductase, a hydroxypyruvate reductase, a glycerate decarboxylase, a 3-phosphoglycerate phosphatase, and a glycerate kinase.

In some embodiments, the recombinant microorganism comprises an ethylene glycol pathway having at least one exogenous nucleic acid encoding ethylene glycol pathway enzymes expressed in a sufficient amount to produce ethylene glycol, the ethylene glycol pathway including a hydroxypyruvate reductase; a hydroxypyruvate decarboxylase, and a glycolaldehyde reductase.

In some embodiments, the recombinant microorganism comprises an ethylene glycol pathway having at least one exogenous nucleic acid encoding ethylene glycol pathway enzymes expressed in a sufficient amount to produce ethylene glycol, the ethylene glycol pathway including a 3-phosphoglycerate phosphatase or a glycerate kinase; a hydroxypyruvate reductase; a hydroxypyruvate decarboxylase, and a glycolaldehyde reductase.

In some embodiments, the recombinant microorganism comprises an ethylene glycol pathway having at least one exogenous nucleic acid encoding an ethylene glycol pathway enzyme expressed in a sufficient amount to produce ethylene glycol, the ethylene glycol pathway including a glycerate decarboxylase.

In some embodiments, the recombinant microorganism comprises an ethylene glycol pathway having at least one exogenous nucleic acid encoding ethylene glycol pathway enzymes expressed in a sufficient amount to produce ethylene glycol, the ethylene glycol pathway including a 3-phosphoglycerate phosphatase or a glycerate kinase and a glycerate decarboxylase.

In some embodiments, the disclosure provides a recombinant microorganism comprising an ethylene glycol pathway, wherein the recombinant microorganism comprises at least one exogenous nucleic acid encoding an enzyme or protein that converts a substrate to a product selected from the group consisting of serine to hydroxypyruvate, hydroxypyruvate to glycolaldehyde, glycolaldehyde to ethylene glycol, serine to ethanolamine, ethanolamine to glycolaldehyde, 3-phosphoglycerate to glycerate, glycerate to hydroxypyruvate, hydroxypyruvate to glycerate, and glycerate to ethylene glycol. One skilled in the art will understand that these are merely exemplary and that any of the substrate-product pairs disclosed herein suitable to produce a desired product and for which an appropriate activity is available for the conversion of the substrate to the product can be readily determined by one skilled in the art based on the teachings herein. Thus, the disclosure provides a recombinant microorganism containing at least one exogenous nucleic acid encoding an enzyme or protein, where the enzyme or protein converts the substrates and products of an ethylene glycol pathway.

While generally described herein as a recombinant microorganism that contains an ethylene glycol pathway, it is understood that the disclosure additionally provides a recombinant microorganism comprising at least one exogenous nucleic acid encoding an ethylene glycol pathway enzyme expressed in a sufficient amount to produce an intermediate of an ethylene glycol pathway. Therefore, in addition to a recombinant microorganism containing an ethylene glycol pathway that produces ethylene glycol, the disclosure additionally provides a recombinant microorganism comprising at least one exogenous nucleic acid encoding an ethylene glycol pathway enzyme, where the microbial organism produces an ethylene glycol pathway intermediate, for example, hydroxypyruvate, ethanolamine, glycolaldehyde, or glycerate.

In some embodiments, a serine aminotransferase or serine oxidoreductase (deaminating) catalyzes the conversion of serine to hydroxypyruvate. In some embodiments, a hydroxypyruvate decarboxylase catalyzes the conversion of hydroxypyruvate to glycolaldehyde. In some embodiments, a glycolaldehyde reductase catalyzes the conversion of glycolaldehyde to ethylene glycol. In some embodiments, a serine decarboxylase catalyzes the conversion of serine to ethanolamine. In some embodiments, an ethanolamine aminotransferase or ethanolamine oxidoreductase (deaminating) catalyzes the conversion of ethanolamine to glycolaldehyde. In some embodiments, a hydroxypyruvate reductase catalyzes the conversion of glycerate to hydroxypyruvate. In some embodiments, a glycerate decarboxylase catalyzes the conversion of glycerate to ethylene glycol. In some embodiments, a 3-phosphoglycerate phosphatase or glycerate kinase catalyzes the conversion of 3-phosphoglycerate to glycerate.

In some embodiments, MEG (or glycolic acid) is produced from the lossless transformation of one or more pentose and/or hexose sugars to D-ribose-5-phosphate intermediate, followed by a conversion of the D-ribose-5-phosphate intermediate to glycolaldehyde and G3P intermediates, followed by a conversion of the glycolaldehyde intermediate to MEG (or glycolic acid) via a C2 pathway, and a conversion of the G3P intermediate to MEG (or glycolic acid) via a C3 pathway.

[K] In one embodiment, the application relates to a recombinant microorganism capable of producing monoethylene glycol (MEG) (or glycolic acid) from one or more pentose and/or hexose sugars and a nitrogen source, wherein the recombinant microorganism from embodiment [A], or from embodiment [B], or from embodiment [C] (and optionally comprising embodiment [D]), and having additionally embodiment [E] or embodiment [F] for production of MEG (or glycolic acid) in a C2 pathway, further expresses one or more of the following from (a) to (h):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having phosphoserine aminotransferase activity that catalyzes the conversion of 3-phosphohydroxypyruvate from (a) to phospho-L-serine;

(c) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(d) at least one endogenous or exogenous nucleic acid molecule encoding an enzyme having phosphoserine phosphatase activity that catalyzes the conversion of phospho-L-serine from (b) to L-serine;

(e) at least one endogenous or exogenous nucleic acid molecule encoding an enzyme having L-serine transaminase or serine oxidase activity that catalyzes the conversion of L-serine from (d) to hydroxypyruvate;

(f) at least one endogenous or exogenous nucleic acid molecule encoding an enzyme having hydroxypyruvate decarboxylase activity that catalyzes the conversion of hydroxypyruvate from (c) or (e) to glycolaldehyde;

(g) at least one endogenous or exogenous nucleic acid molecule encoding an enzyme having glycolaldehyde reductase activity that catalyzes the conversion of glycolaldehyde from (f) to MEG;

(h) at least one endogenous or exogenous nucleic acid molecule encoding an enzyme having glycolaldehyde dehydrogenase activity that catalyzes the conversion of glycolaldehyde from (f) to glycolic acid;

wherein the produced intermediate G3P from embodiment [A], from embodiment [B], or from embodiment [C] is converted to 3-phosphoglycerate through endogenous glycolysis in the recombinant microorganism, and wherein MEG (or glycolic acid) is produced.

[L] In one embodiment, the application relates to a recombinant microorganism capable of producing monoethylene glycol (MEG) (or glycolic acid) from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] or embodiment [F] for production of MEG (or glycolic acid) in a C2 pathway, further expresses one or more of the following from (a) to (j):

(a) at least one endogenous or exogenous nucleic acid molecule encoding an enzyme having 2-phosphoglycerate phosphatase activity and/or an enzyme having glycerate-2-kinase activity that catalyzes the conversion of 2-phosphoglycerate to glycerate;

(b) at least one endogenous or exogenous nucleic acid molecule encoding an enzyme having 3-phosphoglycerate phosphatase activity or an enzyme having glycerate-3-kinase activity that catalyzes the conversion of 3-phosphoglycerate to glycerate;

(c) at least one endogenous or exogenous nucleic acid molecule encoding an enzyme having hydroxypyruvate reductase activity that catalyzes the conversion of glycerate from (a) and/or (b) to hydroxypyruvate;

(d) at least one endogenous or exogenous nucleic acid molecule encoding an enzyme having serine aminotransferase activity or an enzyme having serine oxidoreductase (deaminating) activity that catalyzes the conversion of L-serine to hydroxypyruvate;

(e) at least one endogenous or exogenous nucleic acid molecule encoding an enzyme having L-serine decarboxylase activity that catalyzes the conversion of L-serine to ethanolamine;

(f) at least one endogenous or exogenous nucleic acid molecule encoding an enzyme having hydroxypyruvate decarboxylase activity that catalyzes the conversion of hydroxypyruvate from (c) and/or (d) to glycolaldehyde;

(g) at least one endogenous or exogenous nucleic acid molecule encoding an enzyme having ethanolamine aminotransferase or ethanolamine oidoreductase (deaminating) activity that catalyzes the conversion of ethanolamine from (e) to glycolaldehyde;

(h) at least one endogenous or exogenous nucleic acid molecule encoding an enzyme having glycerate decarboxylase activity that catalyzes the conversion of glycerate from (a) and/or (b) to MEG;

(i) at least one endogenous or exogenous nucleic acid molecule encoding an enzyme having glycolaldehyde reductase activity that catalyzes the conversion of glycolaldehyde from (f) and/or (g) to MEG;

(j) at least one endogenous or exogenous nucleic acid molecule encoding an enzyme having glycolaldehyde dehydrogenase activity that catalyzes the conversion of glycolaldehyde from (f) and/or (g) to glycolic acid;

wherein the produced intermediate G3P from embodiment [A], from embodiment [B], or from embodiment [C] is converted to 3-phosphoglycerate and/or 2-phosphoglycerate through endogenous glycolysis in the recombinant microorganism, and wherein MEG (or glycolic acid) is produced.

In some embodiments, a 2-keto acid decarboxylase, a hydroxypyruvate decarboxylase or a 2-oxoglutarate decarboxylase converts hydroxypyruvate to glycolaldehyde. In some embodiments, the enzyme that converts hydroxypyruvate to glycolaldehyde is encoded by an amino acid sequence having at least 70% sequence identity, having at least 80% sequence identity, or having at least 90% sequence identity to Kivd, dxs, or SucA. In some embodiments, the 2-keto acid decarboxylase is Kivd from *Lactococcus lactis*. In yet another embodiment, the one or more nucleic acid molecules encoding the 2-keto acid decarboxylase comprises an amino acid sequence set forth in SEQ ID NO: 224. In a further embodiment, the one or more nucleic acid molecules encoding the 2-keto acid decarboxylase comprises by a nucleic acid sequence set forth in SEQ ID NO: 223. In some embodiments, the 2-oxoglutarate decarboxylase is SucA from *E. coli*. In yet another embodiment, the one or more nucleic acid molecules encoding the 2-oxoglutarate decarboxylase comprises an amino acid sequence set forth in SEQ ID NO: 226. In a further embodiment, the one or more nucleic acid molecules encoding the 2-oxoglutarate decarboxylase comprises a nucleic acid sequence set forth in SEQ ID NO: 225.

In some embodiments, the hydroxy aldehyde reductase can be a glycolaldehyde reductase. In some embodiments, the enzyme having glycolaldehyde reductase activity is encoded by an amino acid sequence having at least 70% sequence identity, having at least 80% sequence identity, or having at least 90% sequence identity to yqhD or FucO. In some embodiments, the enzyme having glycolaldehyde reductase activity is encoded by one or more nucleic acid molecules obtained from a microorganism selected from *E. coli* and *S. cerevisiae*. In another embodiment, the one or more nucleic acid molecules is selected from gldA, GRE2, GRE3, yqhD, ydjG, fucO, yafB (dkgB), and/or yqhE (dkgA), or homolog thereof. In another embodiment, the one or more nucleic acid molecules is yqhD. In some embodiments, the yqhD comprises a G149E mutation. In a further embodiment, the enzyme having glycolaldehyde reductase activity comprises an amino acid sequence selected from the group consisting of SEQ ID NOs: 13, 15, 17, 20, 23, 25, 28, 30 and 32. In yet a further embodiment, the enzyme having glycolaldehyde reductase activity is encoded by a nucleic acid sequence selected from the group consisting of SEQ ID NOs: 12, 14, 16, 18, 19, 21, 22, 24, 26, 27, 29 and 31.

In some embodiments, the 3-phosphoglycerate dehydrogenase can be a 3-phospho-hydroxypyruvate reductase or a 2-oxoglutarate reductase. In some embodiments, the enzyme having 3-phospho-hydroxypyruvate reductase activity is encoded by an amino acid sequence having at least 70% sequence identity, having at least 80% sequence identity, or having at least 90% sequence identity to serA. In some embodiments, the enzyme having 3-phospho-hydroxypyruvate reductase activity is serA from *E. coli*. In yet another embodiment, the one or more nucleic acid molecules encoding the enzyme having 3-phospho-hydroxypyruvate reductase activity comprises an amino acid sequence set forth in SEQ ID NO: 228. In a further embodiment, the one or more nucleic acid molecules encoding the enzyme having 3-phospho-hydroxypyruvate reductase activity comprises a nucleic acid sequence set forth in SEQ ID NO: 227.

In some embodiments, the 3-phosphoserine aminotransferase can be an L-serine transaminase, a serine aminotransferase or a serine-pyruvate aminotransferase. In some embodiments, the enzyme having 3-phosphoserine aminotransferase activity is encoded by an amino acid sequence having at least 70% sequence identity, having at least 80% sequence identity, or having at least 90% sequence identity to serC. In some embodiments, the enzyme having 3-phosphoserine aminotransferase activity is serC from *E. coli*. In yet another embodiment, the one or more nucleic acid molecules encoding the enzyme having 3-phosphoserine aminotransferase activity comprises an amino acid sequence set forth in SEQ ID NO: 230. In a further embodiment, the one or more nucleic acid molecules encoding the enzyme having 3-phosphoserine aminotransferase activity comprises a nucleic acid sequence set forth in SEQ ID NO: 229.

In some embodiments, the enzyme having serine-pyruvate aminotransferase activity is AGXT1 from *Homo sapiens*. In yet another embodiment, the one or more nucleic acid molecules encoding the enzyme having serine-pyruvate aminotransferase activity comprises an amino acid sequence set forth in SEQ ID NO: 244. In a further embodiment, the one or more nucleic acid molecules encoding the enzyme having serine-pyruvate aminotransferase activity comprises a nucleic acid sequence set forth in SEQ ID NO: 243.

In some embodiments, the enzyme having 3-phospho-hydroxypyruvate phosphatase activity is encoded by an amino acid sequence having at least 70% sequence identity, having at least 80% sequence identity, or having at least 90% sequence identity to yeaB (nudL). In some embodiments, the enzyme having 3-phospho-hydroxypyruvate phosphatase activity is yeaB (nudL) from *E. coli*. In yet another embodiment, the one or more nucleic acid molecules encoding the enzyme having 3-phospho-hydroxypyruvate phosphatase activity comprises an amino acid sequence set forth in SEQ ID NO: 232. In a further embodiment, the one or more nucleic acid molecules encoding the enzyme having 3-phospho-hydroxypyruvate phosphatase activity comprises a nucleic acid sequence set forth in SEQ ID NO: 231.

In some embodiments, the enzyme having phosphoserine phosphatase activity is encoded by an amino acid sequence having at least 70% sequence identity, having at least 80% sequence identity, or having at least 90% sequence identity to serB. In some embodiments, the enzyme having phosphoserine phosphatase activity is serB from *E. coli*. In yet another embodiment, the one or more nucleic acid molecules encoding the enzyme having phosphoserine phosphatase activity comprises an amino acid sequence set forth in SEQ ID NO: 234. In a further embodiment, the one or more nucleic acid molecules encoding the enzyme having phosphoserine phosphatase activity comprises a nucleic acid sequence set forth in SEQ ID NO: 233.

In some embodiments, an enzyme having 2-phosphoglycerate phosphatase activity or an enzyme having glycerate-2-kinase activity converts 2-phosphoglycerate to glycerate. In some embodiments, the enzyme that converts 2-phosphoglycerate to glycerate is encoded by an amino acid sequence having at least 70% sequence identity, having at least 80% sequence identity, or having at least 90% sequence identity to phoA, glxK or garK. In some embodiments, the enzyme having 2-phosphoglycerate phosphatase activity is phoA from *E. coli*. In yet another embodiment, the one or more nucleic acid molecules encoding the enzyme having 2-phosphoglycerate phosphatase activity comprises an amino acid sequence set forth in SEQ ID NO: 246. In a further embodiment, the one or more nucleic acid molecules encoding the enzyme having 2-phosphoglycerate phosphatase activity comprises a nucleic acid sequence set forth in SEQ ID NO: 245. In some embodiments, the enzyme having glycerate-2-kinase activity is glxK from *E. coli*. In yet another embodiment, the one or more nucleic acid molecules encoding the enzyme having glycerate-2-kinase activity comprises an amino acid sequence set forth in SEQ ID NO: 250. In a further embodiment, the one or more nucleic acid molecules encoding the enzyme having glycerate-2-kinase activity comprises a nucleic acid sequence set forth in SEQ ID NO: 249. In some embodiments, the enzyme having glycerate-2-kinase activity is garK from *E. coli*. In yet another embodiment, the one or more nucleic acid molecules encoding the enzyme having glycerate-2-kinase activity comprises an amino acid sequence set forth in SEQ ID NO: 252. In a further embodiment, the one or more nucleic acid molecules encoding the enzyme having glycerate-2-kinase activity comprises a nucleic acid sequence set forth in SEQ ID NO: 251.

In some embodiments, an enzyme having 3-phosphoglycerate phosphatase activity or an enzyme having glycerate-3-kinase activity converts 3-phosphoglycerate to glycerate. In some embodiments, the enzyme that converts 3-phosphoglycerate to glycerate is encoded by an amino acid sequence having at least 70% sequence identity, having at least 80% sequence identity, or having at least 90% sequence identity to phoA or GLYK. In some embodiments, the enzyme having 3-phosphoglycerate phosphatase activity is phoA from *E. coli*. In yet another embodiment, the one or more nucleic acid molecules encoding the enzyme having 3-phosphoglycerate phosphatase activity comprises an amino acid sequence set forth in SEQ ID NO: 246. In a further embodiment, the one or more nucleic acid molecules encoding the enzyme having 3-phosphoglycerate phosphatase activity comprises a nucleic acid sequence set forth in SEQ ID NO: 245. In some embodiments, the enzyme having glycerate-3-kinase activity is GLYK from *Arabidopsis thaliana*. In yet another embodiment, the one or more nucleic acid molecules encoding the enzyme having glycerate-3-kinase activity comprises an amino acid sequence set forth in SEQ ID NO: 248. In a further embodiment, the one or more nucleic acid molecules encoding the enzyme having glycerate-3-kinase activity comprises a nucleic acid sequence set forth in SEQ ID NO: 247.

In some embodiments, an enzyme having hydroxypyruvate reductase activity converts glycerate to hydroxypyruvate. In some embodiments, the enzyme that converts glycerate to hydroxypyruvate is encoded by an amino acid sequence having at least 70% sequence identity, having at least 80% sequence identity, or having at least 90% sequence identity to ghrB. In some embodiments, the enzyme having hydroxypyruvate reductase activity is ghrB from *E. coli*. In yet another embodiment, the one or more nucleic acid molecules encoding the enzyme hydroxypyruvate reductase activity comprises an amino acid sequence set forth in SEQ ID NO: 242. In a further embodiment, the one or more nucleic acid molecules encoding the enzyme hydroxypyruvate reductase activity comprises a nucleic acid sequence set forth in SEQ ID NO: 241.

In some embodiments, an enzyme having serine decarboxylase activity converts L-serine to ethanolamine. In some embodiments, the enzyme that converts L-serine to ethanolamine is encoded by an amino acid sequence having at least 70% sequence identity, having at least 80% sequence identity, or having at least 90% sequence identity to SDC. In some embodiments, the enzyme having serine decarboxylase activity is SDC from *Arabidopsis thaliana*. In yet another embodiment, the one or more nucleic acid molecules encoding the enzyme having serine decarboxylase activity comprises an amino acid sequence set forth in SEQ ID NO: 236. In a further embodiment, the one or more nucleic acid molecules encoding the enzyme having serine decarboxylase activity comprises a nucleic acid sequence set forth in SEQ ID NO: 235.

In some embodiments, an enzyme having ethanolamine aminotransferase activity or an enzyme having ethanolamine oxidoreductase (deaminating) activity converts ethanolamine to glycolaldehyde. In some embodiments, the enzyme that converts ethanolamine to glycolaldehyde is encoded by an amino acid sequence having at least 70% sequence identity, having at least 80% sequence identity, or having at least 90% sequence identity to alaA or tynA. In some embodiments, the enzyme having ethanolamine aminotransferase activity is alaA from *E. coli*. In yet another embodiment, the one or more nucleic acid molecules encoding the enzyme having ethanolamine aminotransferase activity comprises an amino acid sequence set forth in SEQ ID NO: 240. In a further embodiment, the one or more nucleic acid molecules encoding the enzyme having ethanolamine aminotransferase activity comprises a nucleic acid sequence set forth in SEQ ID NO: 239. In some embodiments, the enzyme having ethanolamine oxidoreductase (deaminating) activity is tynA from *E. coli*. In yet another embodiment, the one or more nucleic acid molecules encoding the enzyme having ethanolamine oxidoreductase (deaminating) activity comprises an amino acid sequence set forth in SEQ ID NO: 238. In a further embodiment, the one or more nucleic acid molecules encoding the enzyme having ethanolamine oxidoreductase (deaminating) activity comprises a nucleic acid sequence set forth in SEQ ID NO: 237.

In another aspect, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to one or more co-product via a C3 pathway.

Co-Production of MEG Via a C2 Pathway and Acetone, Isopropanol, Propene and/or Isobutene Via a C3 Pathway In some embodiments, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to acetone via a C3 pathway.

[M] In one embodiment, the application relates to a recombinant microorganism capable of co-producing monoethylene glycol (MEG) and acetone from one or more pentose and/or hexose sugars, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (c):

(a) at least one endogenous or exogenous nucleic acid molecule encoding an enzyme having thiolase or acetyl coenzyme A acetyltransferase activity that catalyzes the conversion of acetyl-CoA to acetoacetyl-CoA;

(b) at least one endogenous or exogenous nucleic acid molecule encoding an enzyme having acetyl-CoA:acetoacetate-CoA transferase activity or an enzyme having acetate:acetoacetyl-CoA hydrolase activity that catalyzes the conversion of acetoacetyl-CoA from (a) to acetoacetate; and/or (c) at least one endogenous or exogenous nucleic acid molecule encoding an enzyme having acetoacetate decarboxylase activity that catalyzes the conversion of acetoacetate from (b) to acetone;
wherein the produced intermediate G3P from embodiment [A] or from embodiment [B] is converted to acetyl-CoA through endogenous glycolysis in the microorganism, and wherein MEG (or glycolic acid) and acetone are co-produced.

In some embodiments, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to isobutene via a C3 pathway.

[N] In some embodiments, the application relates to a recombinant microorganism capable of co-producing monoethylene glycol (MEG) and isobutene from one or more pentose and/or hexose sugars, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (d):

(a) at least one endogenous or exogenous nucleic acid molecule encoding an enzyme having thiolase or acetyl coenzyme A acetyltransferase activity that catalyzes the conversion of acetyl-CoA to acetoacetyl-CoA;

(b) at least one endogenous or exogenous nucleic acid molecule encoding an enzyme having acetyl-CoA:acetoacetate-CoA transferase activity or an enzyme having acetate:acetoacetyl-CoA hydrolase activity that catalyzes the conversion of acetoacetyl-CoA from (a) to acetoacetate;

(c) at least one endogenous or exogenous nucleic acid molecule encoding an enzyme having acetoacetate decarboxylase activity that catalyzes the conversion of acetoacetate from (b) to acetone;

(d) at least one endogenous or exogenous nucleic acid molecule encoding an enzyme having 3-hydroxyisovalerate synthase activity that catalyzes the conversion of acetone from (c) and acetyl-CoA to 3-hydroxyisovalerate (3HIV);
or
wherein the recombinant microorganism expresses one or more of the following from (e) to (j):

(e) at least one endogenous or exogenous nucleic acid molecule encoding an enzyme having thiolase or acetyl coenzyme A acetyltransferase activity that catalyzes the conversion of acetyl-CoA to acetoacetyl-CoA;

(f) at least one endogenous or exogenous nucleic acid molecule encoding an enzyme having hydroxymethylglutaryl-CoA synthase activity that catalyzes the conversion of acetoacetyl-CoA from (e) and acetyl-CoA to 3-hydroxy-3-methylglutaryl-CoA (HMG-CoA);

(g) at least one endogenous or exogenous nucleic acid molecule encoding an enzyme having methylglutaconyl-CoA hydratase activity that catalyzes the conversion of HMG-CoA from (f) to 3-methylglutaconyl-CoA;

(h) at least one endogenous or exogenous nucleic acid molecule encoding an enzyme having methylcrotonyl-CoA carboxylase activity that catalyzes the conversion of 3-methylglutaconyl-CoA from (g) to 3-methylcrotonyl-CoA;

(i) at least one endogenous or exogenous nucleic acid molecule encoding an enzyme having methylcrotonyl-CoA hydratase activity that catalyzes the conversion of 3-methylcrotonyl-CoA from (h) to 3-hydroxyisovaleryl-CoA;

at least one endogenous or exogenous nucleic acid molecule encoding an enzyme having 3-hydroxyisovaleryl-CoA thioesterase activity that catalyzes the conversion of 3-hydroxyisovaleryl-CoA from (i) to 3HIV;
wherein the recombinant microorganism further expresses (a1) and (a2), and/or (b1) selected from:

(a1) at least one endogenous or exogenous nucleic acid molecule encoding an enzyme having 3HIV kinase activity that catalyzes the conversion of 3HIV from (d) or (j) to 3HIV-3-phosphate;

(a2) at least one endogenous or exogenous nucleic acid molecule encoding an enzyme having 3HIV-3-phosphate decarboxylase activity that catalyzes the conversion of 3HIV-3-phosphate from (a1) to isobutene;

(b1) at least one endogenous or exogenous nucleic acid molecule encoding a an enzyme having 3HIV decarboxylase activity that catalyzes the conversion of 3HIV from (d) or (j) to isobutene;
wherein the produced intermediate G3P from embodiment [A], from embodiment [B], or from embodiment [C] is converted to acetyl-CoA through endogenous glycolysis in the microorganism, and wherein MEG and isobutene are co-produced.

In some embodiments, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to isopropanol via a C3 pathway.

[O] In one embodiment, the recombinant microorganisms from embodiment [M] and/or [N] (optionally comprising embodiment [EE]), optionally further express at least one endogenous or exogenous nucleic acid molecule encoding an enzyme having secondary alcohol dehydrogenase activity that catalyzes the conversion of acetone to isopropanol.

In some embodiments, the alcohol dehydrogenase has at least 70% sequence identity, at least 80% sequence identity, or at least 90% sequence identity with an alcohol dehydrogenase from *Clostridium* sp. In other embodiments, the alcohol dehydrogenase is an alcohol dehydrogenase selected from *Clostridium beijerinckii* adh and *Clostridium carboxidivorans* adh. In a further embodiment, the alcohol dehydrogenase comprises an amino acid sequence selected from the group consisting of SEQ ID NOs: 138 and 140. In yet another embodiment, the alcohol dehydrogenase is encoded by a nucleic acid sequence selected from the group consisting of SEQ ID NOs: 136, 137, and 139.

In some embodiments, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to propene via a C3 pathway.

[P] In another embodiment, the recombinant microorganisms from embodiment [O] (optionally comprising embodiment [EE]), optionally further comprises at least one endogenous or exogenous nucleic acid molecule encoding an enzyme having dehydratase activity that catalyzes the conversion of isopropanol to propene.

In one embodiment of any pathway disclosed above for isobutene co-production, the enzyme having 3-hydroxyisovalerate synthase activity is encoded by one or more nucleic acid molecules obtained from a microorganism selected from *Mus* sp., *Saccharomyces* sp., *Lactobacillus* sp. and *Polaromonas* sp. In another embodiment, the enzyme having 3-hydroxyisovalerate synthase activity is encoded by one or more nucleic acid molecules obtained from a microorganism selected from *Mus musculus, Saccharomyces cerevisiae, Lactobacillus crispatus* and *Polaromonas naphthalenivorans*. In some embodiments, the one or more nucleic acid molecules encoding the enzyme having 3-hydroxyisovalerate synthase activity is selected from Hmgcs1, ERG13, PksG and/or Pnap_0477, or homolog thereof. In a further embodiment, the one or more nucleic acid molecules encoding the enzyme having 3-hydroxyisovalerate synthase activity comprises an amino acid sequence selected from the group consisting of SEQ ID NOs: 105, 107, 109 and 111. In yet another embodiment, the one or more nucleic acid molecules encoding the enzyme having 3-hydroxyisovalerate synthase activity comprises a nucleic acid sequence selected from the group consisting of SEQ ID NOs: 104, 106, 108 and 110.

In one embodiment of any pathway disclosed above for isobutene co-production, the enzyme having hydroxymethylglutaryl-CoA synthase activity is encoded by one or more nucleic acid molecules obtained from *Saccharomyces* sp. In another embodiment, the enzyme having hydroxymethylglutaryl-CoA synthase activity is encoded by one or more nucleic acid molecules obtained from *Saccharomyces cerevisiae*. In some embodiments, the one or more nucleic acid molecules encoding the enzyme having hydroxymethylglutaryl-CoA synthase activity is HmgS, or homolog thereof. In a further embodiment, the one or more nucleic acid molecules encoding the enzyme having hydroxymethylglutaryl-CoA synthase activity comprises an amino acid sequence set forth in SEQ ID NO: 123. In yet another embodiment, the one or more nucleic acid molecules encoding the enzyme having hydroxymethylglutaryl-CoA synthase activity comprises a nucleic acid sequence set forth in SEQ ID NO: 122.

In one embodiment of any pathway disclosed above for isobutene co-production, the enzyme having methylglutaconyl-CoA hydratase activity is encoded by one or more nucleic acid molecules obtained from *Pseudomonas* sp. In another embodiment, the enzyme having methylglutaconyl-CoA hydratase activity is encoded by one or more nucleic acid molecules obtained from *Pseudomonas putida*. In some embodiments, the one or more nucleic acid molecules encoding the enzyme having methylglutaconyl-CoA hydratase activity is liuC, or homolog thereof. In a further embodiment, the one or more nucleic acid molecules encoding the enzyme having methylglutaconyl-CoA hydratase activity comprises an amino acid sequence set forth in SEQ ID NO: 125. In yet another embodiment, the one or more nucleic acid molecules encoding the enzyme having methylglutaconyl-CoA hydratase activity comprises a nucleic acid sequence set forth in SEQ ID NO: 124.

In one embodiment of any pathway disclosed above for isobutene co-production, the enzyme having methylcrotonyl-CoA carboxylase activity is encoded by one or more nucleic acid molecules obtained from *Pseudomonas* sp. In another embodiment, the enzyme having methylcrotonyl-CoA carboxylase activity is encoded by one or more nucleic acid molecules obtained from *Pseudomonas aeruginosa*. In some embodiments, the one or more nucleic acid molecules encoding the enzyme having methylcrotonyl-CoA carboxylase activity is liuB, and/or liuD, or homologs thereof. In a further embodiment, the one or more nucleic acid molecules encoding the enzyme having methylcrotonyl-CoA carboxylase activity comprises an amino acid sequence selected from SEQ ID NOs: 127 and 129. In yet another embodiment, the one or more nucleic acid molecules encoding the enzyme having methylcrotonyl-CoA carboxylase activity comprises a nucleic acid sequence selected from SEQ ID NOs: 126 and 128.

In one embodiment of any pathway disclosed above for isobutene co-production, the enzyme having methylcrotonyl-CoA hydratase activity is a 3-ketoacyl-CoA thiolase. In another embodiment, the enzyme having methylcrotonyl-CoA hydratase activity is an enoyl-CoA hydratase. In another embodiment, the enzyme having methylcrotonyl-CoA hydratase activity is encoded by one or more nucleic acid molecules obtained from *E. coli*. In some embodiments, the one or more nucleic acid molecules encoding the enzyme having methylcrotonyl-CoA hydratase activity is fadA, and/or fadB, or homologs thereof. In a further embodiment, the one or more nucleic acid molecules encoding the enzyme having methylcrotonyl-CoA hydratase activity comprises an amino acid sequence selected from SEQ ID NOs: 131 and 133. In yet another embodiment, the one or more nucleic acid molecules encoding the enzyme having methylcrotonyl-CoA hydratase activity comprises a nucleic acid sequence selected from SEQ ID NOs: 130 and 132.

In one embodiment of any pathway disclosed above for isobutene co-production, the enzyme having 3-hydroxyisovaleryl-CoA thioesterase activity is encoded by one or more nucleic acid molecules obtained from *E. coli*. In some embodiments, the one or more nucleic acid molecules encoding the enzyme having 3-hydroxyisovaleryl-CoA thioesterase activity is tesB, or homolog thereof. In a further embodiment, the one or more nucleic acid molecules encoding the enzyme having 3-hydroxyisovaleryl-CoA thioesterase activity comprises an amino acid sequence set forth in SEQ ID NO: 135. In yet another embodiment, the one or more nucleic acid molecules encoding the enzyme having 3-hydroxyisovaleryl-CoA thioesterase activity comprises a nucleic acid sequence set forth in SEQ ID NO: 134.

In one embodiment of any pathway disclosed above for isobutene co-production, the enzyme having 3HIV kinase activity is encoded by one or more nucleic acid molecules obtained from a microorganism selected from the group consisting of *Thermoplasma* sp. and *Picrophilus* sp. In another embodiment, the enzyme having 3HIV kinase activity is encoded by one or more nucleic acid molecules obtained from a microorganism selected from the group consisting of *Thermoplasma acidophilum* and *Picrophilus torridus*. In some embodiments, the one or more nucleic acid molecules encoding the enzyme having 3HIV kinase activity is TA1305 and/or PTO1356, or homolog thereof. In some embodiments, the TA1305 comprises a L200E mutation. In a further embodiment, the one or more nucleic acid molecules encoding the enzyme having 3HIV kinase activity comprises an amino acid sequence selected from the group consisting of SEQ ID NOs: 113, 115 and 117. In yet another embodiment, the one or more nucleic acid molecules encoding the enzyme having 3HIV kinase activity comprises a nucleic acid sequence selected from the group consisting of SEQ ID NOs: 112, 114 and 116.

In one embodiment of any pathway disclosed above for isobutene co-production, the enzyme having 3HIV-3-phosphate decarboxylase activity is encoded by one or more nucleic acid molecules obtained from *Streptococcus* sp. In another embodiment, the enzyme having 3HIV-3-phosphate decarboxylase activity is encoded by one or more nucleic acid molecules obtained from a microorganism selected from *Streptococcus mitis* and *Streptococcus gordonii*. In some embodiments, the one or more nucleic acid molecules encoding the enzyme having 3HIV-3-phosphate decarboxylase activity comprises smi_1746 and/or mvaD, or homolog thereof. In a further embodiment, the one or more nucleic acid molecules encoding the enzyme having 3HIV-3-phosphate decarboxylase activity comprises an amino acid sequence selected from SEQ ID NOs: 119 and 121. In yet another embodiment, the one or more nucleic acid molecules encoding the enzyme having 3HIV-3-phosphate decarboxylase activity comprises a nucleic acid sequence selected from SEQ ID NOs: 118 and 120.

In one embodiment of any pathway disclosed above for isobutene co-production, the enzyme having 3HIV decarboxylase activity is encoded by one or more nucleic acid molecules obtained from a microorganism selected from the group consisting of *Streptococcus* sp., *Thermoplasma* sp. and *Picrophilus* sp. In another embodiment, the enzyme having 3HIV decarboxylase activity is encoded by one or more nucleic acid molecules obtained from a microorganism selected from the group consisting of *Streptococcus gordonii*, *Thermoplasma acidophilum* and *Picrophilus torridus*. In some embodiments, the one or more nucleic acid molecules encoding the enzyme having 3HIV decarboxylase activity comprises mvaD, TA1305 and/or PTO1356, or homolog thereof. In a further embodiment, the one or more nucleic acid molecules encoding the enzyme having 3HIV decarboxylase activity comprises an amino acid sequence selected from the group consisting of SEQ ID NOs: 113, 117 and 121. In yet another embodiment, the one or more nucleic acid molecules encoding the enzyme having 3HIV decarboxylase activity comprises a nucleic acid sequence selected from the group consisting of SEQ ID NOs: 112, 116 and 120.

Figure 6:
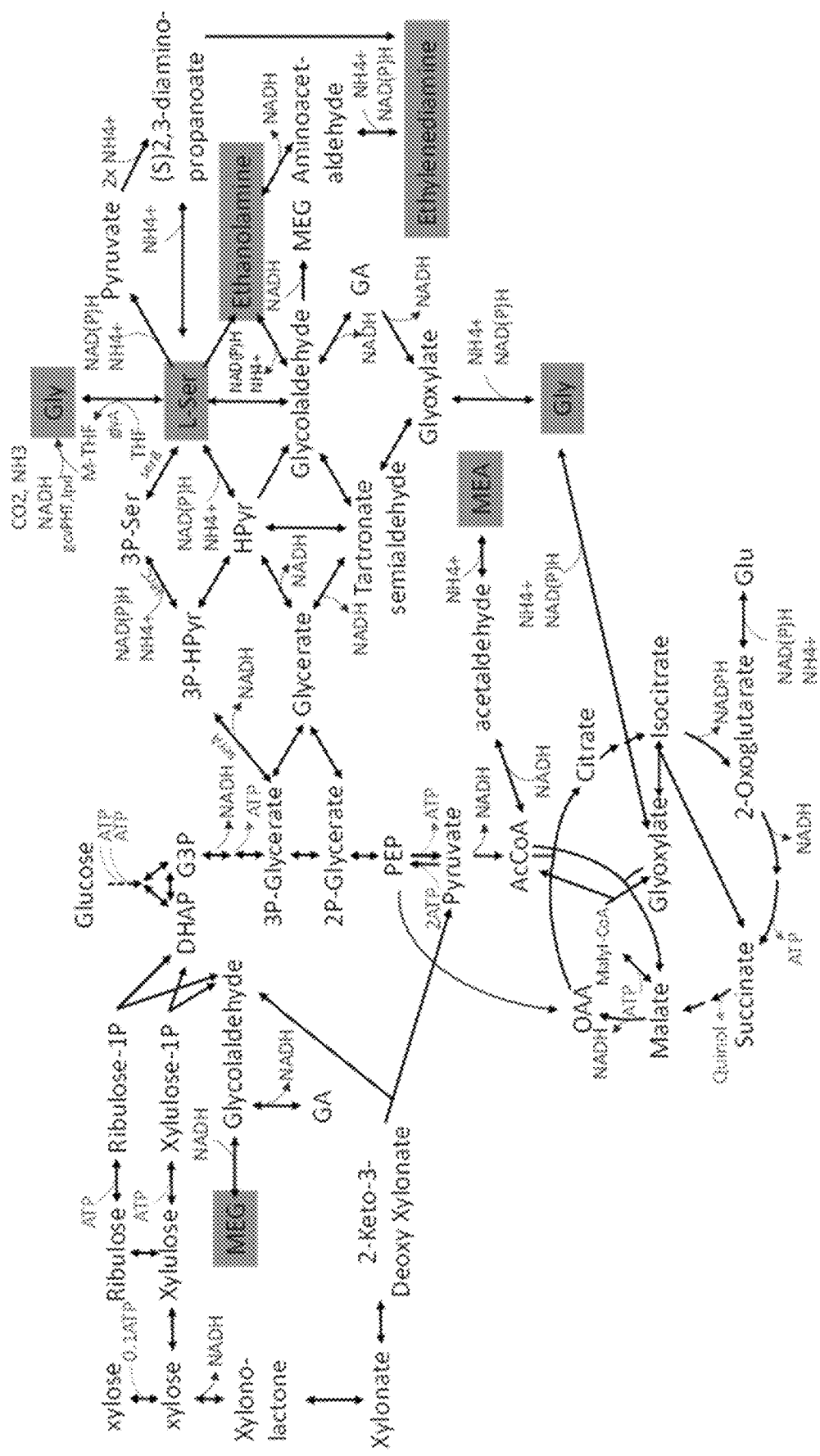
FIG. 6 illustrates an overview of the MEG and Ser, Gly, MEA, EDA co-production pathways.

Co-Production of MEG Via a C2 Pathway and One or More Serine Pathway Compound Via a C3 Pathway In some embodiments, the production of MEG via a C2 pathway is coupled to the production of one or more serine pathway compound via a C3 pathway. In one embodiment, one or more serine pathway compound relates to the L-serine biosynthetic pathway. In another embodiment, the one or more serine pathway compound is L-serine (Ser), glycine (Gly), monoethanolamine (MEA), and/or ethylenediamine (EDA) (FIG. 6).

Production of Monoethylene Glycol (MEG) or Glycolic Acid Via a C2 Pathway

As discussed above, all currently known MEG (or glycolic acid) production methods using glucose as feedstock have low yield potential. This is an intrinsic drawback of the biochemistry of how glucose is degraded to MEG, with one decarboxylation occurring per produced MEG (or glycolic acid) molecule for all the proposed and known pathways. However, one decarboxylation per MEG is too much to achieve redox-neutral and therefore optimal yield.

To produce MEG in the present disclosure, one or more pentose and/or hexose sugars are converted to a pentose-phosphate intermediate via a non-oxidative entry into the pentose phosphate pathway in a manner that preserves yield potential, as described above. The pentose-phosphate intermediate, wherein the pentose-phosphate intermediate is D-ribose-5-phosphate, D-ribulose-5-phosphate or D-xylulose-5-phosphate, is then converted to glycolaldehyde and G3P via an enzyme having pentose-phosphate aldolase activity, wherein the aldolase has D-ribose-5-phosphate aldolase activity, D-ribulose-5-phosphate aldolase activity, or D-xylulose-5-phosphate aldolase activity. The glycolaldehyde intermediate is reduced to MEG, consuming an NADH. Alternatively, glycolaldehyde can be oxidized by a glycolaldehyde dehydrogenase to glycolic acid. The $C_3$ compound G3P is further oxidized to one or more of the L-serine pathway compounds Ser, Gly, MEA, or EDA, producing NADH.

To reduce ATP requirements and optimize yield potential, D-xylose is preferably imported by a H+/xylose symporter, such as XylE from *E. coli*, or a passive, energy independent facilitator, rather than an active ABC-type transporter such as XylFGH from *E. coli*, which utilizes 1 ATP per transported molecule. While a symporter does not directly consume ATP, its degradation of the proton gradient is equivalent to utilization of around 0.1 ATP. In all following equations, this indirect ATP consumption as well as ATP required for cell maintenance are not accounted for.

Ammonia ($NH_3$)

Ammonia is a compound of nitrogen and hydrogen with the formular $NH_3$, which serves as a precursor to food and fertilizers as well as a building block for the synthesis of pharmaceutical products and commercial cleaning products. Ammonia is present as an ammonium cation when it is positively charged, whose chemical formula is $NH_4^+$.

The present disclosure teaches that ammonia or a similar compound is utilized as nitrogen source. When ammonia or a similar compound is used as a nitrogen source, it is fixed into organic matter, for example, glutamate. In one embodiment, when 2-oxoglutarate is usually formed into glutamate, the ammonia is fixed and this process consumes one NADH.

Production of L-serine (Ser)

Ser is produced by the natural pathway via 3-phosphoserine or a variation thereof. In one embodiment, G3P produced from the conversion of D-ribose 5-phosphate by a D-ribose 5-phosphate aldolase is converted by endogenous glycolysis in the microorganism to 3-phospho-D-glycerate (3-phosphoglycerate). 3-phosphoglycerate is converted to 3-phosphohydroxypyruvate by a D-3-phosphoglycerate dehydrogenase (EC 1.1.1.95). The 3-phosphohydroxypyruvate is then converted to 3-phosphoserine by a 3-phosphoserine aminotransferase (EC 2.6.1.52). The 3-phosphoserine is then converted to L-serine by a phosphoserine phosphatase (EC 3.1.3.3).

In some embodiments the reaction from 3-phosphoglycerate to L-serine is the following:

3-phospho-D-glycerate+$NAD^+$+L-glutamate+ $H_2O$→L-serine+NADH+2-oxoglutarate+phosphate Considering the production of two NADH from G3P to 3-phosphohydroxypyruvate and one NADH required for fixation of $NH_3$, Ser production produces exactly one excess NADH, which is needed for the equimolar co-production of one MEG (or glycolic acid).

In some embodiments, the production of MEG and L-serine is very close to the thermodynamic maximum yield potential using the lossless conversion of one or more pentose and/or hexose sugars a pentose-phosphate intermediate, followed by the conversion of the D-ribose-5-phosphate intermediate to glycolaldehyde and D-glyceraldehyde-3-phosphate (G3P) intermediates, and then followed by the co-production of MEG via reduction of glycolaldehyde and L-serine via one or more C3 pathways from the G3P intermediate. In some embodiments, the thermodynamic yield potential is 14% better for co-production of MEG and L-serine via the pathways disclosed in the present application compared to production of L-serine made from glucose by the natural, standard C3 pathway.

Co-production: (pentose or hexose)+$NH_3$→MEG+ Ser+0 ATP*

Y(pathway)=(0.371+0.629) g/g=1.00 g (MEG+Ser)/g ((pentose or hexose)+$NH_3$), 96% of Y(max)(heat of combustion)=1.044 g/g Standard pathway: glucose+$2NH_3$→2Ser+2NADH+0 ATP Y(pathway)=0.981 g (Ser)/g((pentose or hexose)+$2NH_3$), 84% of Y(max)(heat of combustion)=1.164 g/g

*Passive or $H^+$ symport transport of D-xylose, a pentose, is assumed. Indirect ATP consumption for a $H^+$ symporter or ATP required for cell maintenance are not accounted for.

In some embodiments, MEG and L-serine are co-produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to Lserine via one or more C3 pathways.

[Q] In one embodiment, the application relates to a recombinant microorganism capable of co-producing monoethylene glycol (MEG) and L-serine from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (h):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having 3-phosphoglycerate phosphatase activity and/or an enzyme having glycerate 3-kinase activity that catalyzes the conversion of 3-phosphoglycerate to glycerate;

(c) at least one endogenous or exogenous nucleic acid molecule encoding an enzyme having 2-phosphoglycerate phosphatase activity and/or an enzyme having glycerate 2-kinase activity that catalyzes the conversion of 2-phosphoglycerate to glycerate;

(d) at least one endogenous or exogenous nucleic acid molecule encoding an enzyme having phosphoserine aminotransferase activity that catalyzes the conversion of 3-phosphohydroxypyruvate from (a) to phospho-L-serine;

(e) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(f) at least one endogenous or exogenous nucleic acid molecule encoding an enzyme having phosphoserine phosphatase activity that catalyzes the conversion of phospho-L-serine from (d) to L-serine;

(g) at least one endogenous or exogenous nucleic acid molecule encoding an enzyme having hydroxypyruvate reductase activity that catalyzes the conversion of glycerate from (b) and/or (c) to hydroxypyruvate;

(h) at least one endogenous or exogenous nucleic acid molecule encoding an enzyme having serine-pyruvate aminotransferase activity that catalyzes the conversion of hydroxypyruvate from (e) and/or (g) to L-serine;

wherein the produced intermediate G3P from embodiment [A], from embodiment [B], or from embodiment [C] is converted to 3-phosphoglycerate and/or 2-phosphoglycerate through endogenous glycolysis in the microorganism, and wherein MEG and L-serine are produced.

Production of Glycine (Gly)

Gly is produced by natural pathways, for instance via Ser, or variations thereof.

In one embodiment, Gly is produced via a Ser based pathway. In the Ser based pathway, 5,10-methylene tetrahydrofolate (M-THF) is produced from THF and L-serine is converted to glycine by a serine hydroxymethyltransferase. M-THF is utilized in the biosynthesis of various cellular compounds, for instance in methylation reactions.

In a preferred embodiment, M-THF can also be used to produce two more NADH or one NADH and one Hz:

M-THF+$H_2O$↔THF+formaldehyde (EC 2.1.2.-; transferases such as hydroxymethyl-, formyl- and related transferases that transfers one-carbon group), subsequent oxidation of formaldehyde (EC 1.2.1.46; formaldehyde dehydrogenase) to formate and NADH, and further oxidation of formate to $CO_2$ and NADH (formate dehydrogenase, FDH) or $CO_2$ and Hz (formate hydrogenlyase complex).

In some embodiments, this reconstitution of THF, if done partially, can be used to generate just enough NADH to perform another, distinct glycine biosynthesis route. In one embodiment, the route via the glycine cleavage system, which utilizes M-THF, $NH_3$, $CO_2$ and NADH to synthesize glycine directly, can be used together with the serine based glycine production to utilize the generated excess M-THF to generate more glycine.

The glycine-cleavage system (GCV) is a multienzyme complex that catalyzes the reversible oxidation of glycine, yielding carbon dioxide, ammonia, 5,10-methylenetetrahydrofolate (M-THF) and a reduced pyridine nucleotide:

Glycine+THF+NAD$^+$↔M-THF+CO$_2$+NH$_3$+NADH+

Tetrahydrofolate serves as a recipient for one-carbon units generated during glycine cleavage to form the methylene group. The GCV system consists of four protein components, the P protein, H protein, T protein, and L protein. P protein (EC 1.4.4.2, glycine dehydrogenase (decarboxylating)) catalyzes the pyridoxal phosphate-dependent liberation of CO$_2$ from glycine, leaving a methylamine moiety. The methylamine moiety is transferred to the lipoic acid group of the H protein, which is bound to the P protein prior to decarboxylation of glycine. The T protein (EC 2.1.2.10, aminomethyltransferase) catalyzes the release of NH$_3$ from the methylamine group and transfers the remaining 01 unit to THF, forming 5,10-mTHF. The L protein (EC 1.8.1.4, dihydrolipoyl dehydrogenase) then oxidizes the lipoic acid component of the H protein and transfers the electrons to NAD+, forming NADH.

The same set of enzymes is sometimes referred to as glycine synthase when it runs in the reverse direction to form glycine. In the anaerobic bacteria, *Clostridium acidiurici*, the glycine cleavage system runs mostly in the direction of glycine synthesis.

Alternatively, in another embodiment, glycine can also be produced via transamination of glyoxylate by alanine-glyoxylate aminotransferase (EC 2.6.1.44). Though in organisms like *Saccharomyces cerevisiae*, this pathway is only expressed during growth on non-fermentable carbon sources like ethanol or acetate, this pathway can be readily overexpressed in any microorganism. The amino group donor alanine gets reconstituted by transamination with glutamate (alanine transaminase, EC 2.6.1.2), which in turn gets reconstituted by fixation of ammonia by a NADH or NADPH dependent glutamate dehydrogenase (EC 1.4.1.2 or EC 1.4.1.3). In one embodiment, this glycine pathway avoids the intermediate L-serine and does not lead to the production of M-THF, but rather directly produces two reducing equivalents such as NADH.

In some embodiments, the production of MEG and glycine is very close to the thermodynamic maximum yield potential using the lossless conversion of one or more pentose and/or hexose sugars to D-ribose-5-phosphate intermediate, followed by the conversion of the D-ribose-5-phosphate intermediate to glycolaldehyde and D-glyceraldehyde-3-phosphate (G3P) intermediates, and then followed by the co-production of MEG via reduction of glycolaldehyde and glycine via one or more C3 pathways from the G3P intermediate. In some embodiments, the thermodynamic yield potential is 37% better for co-production of MEG (or glycolic acid) and glycine via the pathways disclosed in the present application compared to production of glycine made from glucose by the natural, standard C3 pathway.

Co-production, serine pathway: (pentose or hexose)+NH$_3$+THF→MEG+Gly+M-THF+0 ATP*

Co-production, serine pathway, assuming THF reconstitution via formate and using FDH:

(pentose or hexose)+NH$_3$→MEG+Gly+2NADH+0 ATP*

Co-production, glyoxylate pathway: (pentose or hexose)+NH$_3$→MEG+Gly+2 NAD(P)H+0 ATP*

Y(pathway)=(0.371+0.449) g/g=0.820 g(MEG+Gly)/g ((pentose or hexose)+NH$_3$), 81% of Y(max)(heat of combustion)=1.013 g/g Co-production, serine pathway, assuming partial THF reconstitution via formate and FDH plus glycine synthesis via glycine cleavage system:

Partial THF reconstitution through NADH production: M-THF→2/3M-THF+1/3THF+2/3NADH Utilization of remaining M-THF and generated NADH for glycine cleavage system:

2/3M-THF+2/3NADH+2/3NH$_3$+2/3CO$_2$→2/3Gly (pentose or hexose)+5/3NH$_3$+2/3CO$_2$→MEG+5/3Gly+0ATP* y(pathway)=(0.348+0.698)g/g=1.046 g/g, 97% of y(max)=1.076 g/g

Standard pathway: glucose+2NH$_3$+2THF→2Gly+2M-THF+2NADH+0 ATP

Y(pathway)=0.701 g(Gly)/g(glucose+2NH3), 59% of Y(max)(heat of combustion)=1.197 g/g

*Passive or H+ symport transport of D-xylose, a pentose, is assumed. Indirect ATP consumption for a H+ symporter or ATP required for cell maintenance are not accounted for.

In some embodiments, MEG and glycine are co-produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to glycine via one or more C3 pathways.

[R] In one embodiment, the application relates to a recombinant microorganism capable of co-producing monoethylene glycol (MEG) and glycine from one or more pentose and/or hexose sugars and a nitrogen source, wherein the recombinant microorganism from embodiment [A], from embodiment [B] or from embodiment [C] (and optionally comprising embodiment [D]), and having additionally embodiment [E] for production of MEG in a C2 pathway, further expresses one or more of the following from (a) to (e):

(a) at least one endogenous or exogenous nucleic acid molecule encoding an enzyme having serine hydroxymethyltransferase activity that catalyzes the conversion of L-serine and tetrahydrofolate (THF) to glycine and 5,10-methylene tetrahydrofolate (M-THF);

(b) at least one endogenous or exogenous nucleic acid molecule encoding an enzyme having transferase activity that catalyzes the conversion of M-THF from (a) to formaldehyde;

(c) at least one endogenous or exogenous nucleic acid molecule encoding an enzyme having formaldehyde dehydrogenase activity that catalyzes the conversion of formaldehyde from (b) to formate and NADH;

(d) at least one endogenous or exogenous nucleic acid molecule encoding an enzyme having formate dehydrogenase activity that catalyzes the conversion of formate from (c) to CO$_2$ and NADH;

(e) at least one endogenous or exogenous nucleic acid molecule encoding a protein of the glycine cleavage system that catalyze the conversion of M-THF from (a), CO$_2$, NH$_3$ and NADH from (c) or (d) to glycine and THF;

wherein THF is reconstituted from steps (b) through (e), wherein optionally formate from (c) is further oxidized to CO$_2$ and H$_2$ by a formate hydrogenlyase complex, and wherein MEG and glycine are produced.

[S] In one embodiment, the application relates to a recombinant microorganism capable of co-producing monoethylene glycol (MEG) and glycine from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (k):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having phosphoserine aminotransferase activity that catalyzes the conversion of 3-phosphohydroxypyruvate from (a) to phospho-L-serine;

(c) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(d) at least one endogenous or exogenous nucleic acid molecule encoding an enzyme having phosphoserine phosphatase activity that catalyzes the conversion of phospho-L-serine from (b) to L-serine;

(e) at least one endogenous or exogenous nucleic acid molecule encoding an enzyme having L-serine transaminase or serine oxidase activity that catalyzes the conversion of L-serine from (d) to hydroxypyruvate;

(f) at least one endogenous or exogenous nucleic acid molecule encoding an enzyme having hydroxypyruvate decarboxylase activity that catalyzes the conversion of hydroxypyruvate from (c) or (e) to glycolaldehyde;

(g) at least one endogenous or exogenous nucleic acid molecule encoding an enzyme having glycolaldehyde dehydrogenase activity that catalyzes the conversion of glycolaldehyde from (f) to glycolic acid;

(h) at least one endogenous or exogenous nucleic acid molecule encoding an enzyme having glycolate dehydrogenase activity that catalyzes the conversion of glycolic acid from (g) to glyoxylate;

(i) at least one endogenous or exogenous nucleic acid molecule encoding an enzyme having alanine-glyoxylate aminotransferase activity that catalyzes the conversion of glyoxylate from (h) and alanine to glycine and pyruvate;

(j) at least one endogenous or exogenous nucleic acid molecule encoding an enzyme having alanine transaminase activity that catalyzes the conversion of pyruvate from (i) and glutamate to alanine and 2-oxoglutarate;

(k) at least one endogenous or exogenous nucleic acid molecule encoding an enzyme having NAD(P)H dependent glutamate dehydrogenase activity that catalyzes the conversion of 2-oxoglutarate from (j) and ammonia to glutamate; wherein the produced intermediate G3P from embodiment [A] or from embodiment [B] is converted to 3-phosphoglycerate and/or 2-phosphoglycerate through endogenous glycolysis in the microorganism, wherein the glyoxylate for step (i) optionally comes from glyoxylate shunt in the microorganism, wherein alanine and glutamate are reconstituted from steps (j) and (k), and wherein MEG and glycine are co-produced.

[T] In one embodiment, the application relates to a recombinant microorganism capable of co-producing monoethylene glycol (MEG) and glycine from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (l):

(a) at least one endogenous or exogenous nucleic acid molecule encoding an enzyme having 2-phosphoglycerate phosphatase activity and/or an enzyme having glycerate-2-kinase activity that catalyzes the conversion of 2-phosphoglycerate to glycerate;

(b) at least one endogenous or exogenous nucleic acid molecule encoding an enzyme having 3-phosphoglycerate phosphatase activity and/or an enzyme having glycerate-3-kinase activity that catalyzes the conversion of 3-phosphoglycerate to glycerate;

(c) at least one endogenous or exogenous nucleic acid molecule encoding an enzyme having hydroxypyruvate reductase activity that catalyzes the conversion of glycerate from (a) and/or (b) to hydroxypyruvate;

(d) at least one endogenous or exogenous nucleic acid molecule encoding an enzyme having serine aminotransferase or serine oxidoreductase (deaminating) activity that catalyzes the conversion of L-serine to hydroxypyruvate;

(e) at least one endogenous or exogenous nucleic acid molecule encoding an enzyme having L-serine decarboxylase activity that catalyzes the conversion of L-serine to ethanolamine;

(f) at least one endogenous or exogenous nucleic acid molecule encoding an enzyme having hydroxypyruvate decarboxylase activity that catalyzes the conversion of hydroxypyruvate from (c) and/or (d) to glycolaldehyde;

(g) at least one endogenous or exogenous nucleic acid molecule encoding an enzyme having ethanolamine aminotransferase activity or an enzyme having ethanolamine oidoreductase (deaminating) activity that catalyzes the conversion of ethanolamine from (e) to glycolaldehyde;

(h) at least one endogenous or exogenous nucleic acid molecule encoding an enzyme having glycolaldehyde dehydrogenase activity that catalyzes the conversion of glycolaldehyde from (f) and/or (g) to glycolic acid;

(i) at least one endogenous or exogenous nucleic acid molecule encoding an enzyme having glycolate dehydrogenase activity that catalyzes the conversion of glycolic acid from (g) to glyoxylate;

(j) at least one endogenous or exogenous nucleic acid molecule encoding an enzyme having alanine-glyoxylate aminotransferase activity that catalyzes the conversion of glyoxylate from (i) and alanine to glycine and pyruvate;

(k) at least one endogenous or exogenous nucleic acid molecule encoding an enzyme having alanine transaminase activity that catalyzes the conversion of pyruvate from (j) and glutamate to alanine and 2-oxoglutarate;

(l) at least one endogenous or exogenous nucleic acid molecule encoding an enzyme having NAD(P)H dependent glutamate dehydrogenase activity that catalyzes the conversion of 2-oxoglutarate from (k) and ammonia to glutamate; wherein the produced intermediate G3P from embodiment [A]. from embodiment [B], or from embodiment [C] is converted to 3-phosphoglycerate and/or 2-phosphoglycerate through endogenous glycolysis in the microorganism, wherein the glyoxylate for step (j) optionally comes from glyoxylate shunt in the microorganism, wherein alanine and glutamate are reconstituted from steps (k) and (l), and wherein MEG and glycine are co-produced.

In some embodiments, an enzyme having serine hydroxymethyltransferase activity converts L-serine to glycine. In some embodiments, the enzyme that converts L-serine to glycine is encoded by an amino acid sequence having at least 70% sequence identity, having at least 80% sequence identity, or having at least 90% sequence identity to *E. coli* glyA. In some embodiments, the one or more nucleic acid molecule encoding an enzyme having serine hydroxymethyltransferase activity comprises an amino acid sequence set forth in UniProt ID P0A825. In a further embodiment, the one or more nucleic acid molecule encoding an enzyme having serine hydroxymethyltransferase activity is encoded by a nucleic acid sequence set forth in Gene ID 947022.

In some embodiments, an enzyme having transferase activity that transfers one-carbon groups is used to convert M-THF to formaldehyde. Transferases such as the hydroxymethyl-, formyl- and related transferases may be used. Examples of hydroxymethyl-, formyl- and related transferases include glycine hydroxymethyltransferase, phosphoribosylglycinamide formyltransferase, phosphoribosylaminoimidazolecarboxamide formyltransferase, glycine formimidoyltransferase, glutamate formiminotransferase, D-alanine 2-hydroxymethyltransferase, deoxycytidylate 5-hydroxymethyltransferase, methionyl-tRNA formyltransferase, aminomethyltransferase, 3-methyl-2-oxobutanoate hydroxymethyltransferase and UDP-4-amino-4-deoxy-L-arabinose formyltransferase.

In some embodiments, an enzyme having formaldehyde dehydrogenase activity is used to convert formaldehyde to formate and NADH. In some embodiments, the enzyme having formaldehyde dehydrogenase activity is encoded by an amino acid sequence having at least 70% sequence identity, having at least 80% sequence identity, or having at least 90% sequence identity to a formaldehyde dehydrogenase selected from *Saccharomyces cerevisiae* ALD2, *Saccharomyces cerevisiae* ALD3, *Homo sapiens* ALDH3A2, and *Homo sapiens* ALDH9A1. In some embodiments, the one or more nucleic acid molecule encoding an enzyme having formaldehyde dehydrogenase activity comprises an amino acid sequence selected from UniProt ID P47771, UniProt ID P54114, UniProt ID P51648 and UniProt ID P49189. In a further embodiment, the one or more nucleic acid molecule encoding an enzyme having formaldehyde dehydrogenase activity is encoded by a nucleic acid sequence selected from Gene ID 855206, Gene ID 855205, Gene ID 224 and Gene ID 223.

In some embodiments, an enzyme having formate dehydrogenase activity is used to convert formate to $CO_2$ and NADH. In some embodiments, the enzyme having formate dehydrogenase activity is encoded by an amino acid sequence having at least 70% sequence identity, having at least 80% sequence identity, or having at least 90% sequence identity to an enzyme having formate dehydrogenase activity selected from the group consisting of *E. coli* fdhF (chlF, FDH-H), *E. coli* FDH-N, *E. coli* FDH-O, *Candida boidinii* FDH1, *Corynebacterium glutamicum* fdhF, *Cupriavidus oxalaticus* NAD+-dependent formate dehydrogenase, *Gottschalkia acidurici* NAD+-dependent formate dehydrogenase, *Methylobacterium extorquens* Fdh1, *Methylosinus trichosporium* formate dehydrogenase, and *Moraxella* sp. NAD+-dependent formate dehydrogenase fdh. In some embodiments, the one or more nucleic acid molecule encoding an enzyme or subunit of an enzyme associated with formate dehydrogenase activity comprises an amino acid sequence selected from UniProt ID P07658, UniProt ID P0AEK7, UniProt ID P0AAJ3, UniProt ID P24183, UniProt ID P32176, UniProt ID P0AAJ5, UniProt ID P0AEL0, UniProt ID O13437, UniProt ID Q8NSY6, UniProt ID Q8KT17, UniProt ID Q8KT18, and UniProt ID O08375. In a further embodiment, the one or more nucleic acid molecule encoding an enzyme or subunit of an enzyme associated with formate dehydrogenase activity comprises a nucleic acid sequence selected from Gene ID 948584, Gene ID 946038, Gene ID 948794, Gene ID 946035, Gene ID 948394, Gene ID 948395, Gene ID 948383, GenBank accession AJ011046.2, Gene ID 1021531, GenBank accession AF489516, and GenBank accession Y13245.1.

In some embodiments, one or more proteins of the glycine cleavage system are used to produce glycine from M-THF, $CO_2$, $NH_3$ and NADH. In some embodiments, the proteins of the glycine cleavage system comprise: i) P-protein (a pyridoxal phosphate-containing protein) or glycine decarboxylase (EC 1.4.4.2), ii) T-protein or aminomethyl-transferase (EC 2.1.2.10), iii) L-protein or dihydrolipoamide dehydrogenase (EC1.8.1.4), and iv) a carrier protein called H-protein (a lipoic acid-containing protein). In some embodiments, the enzyme having glycine decarboxylase activity is encoded by an amino acid sequence having at least 70% sequence identity, having at least 80% sequence identity, or having at least 90% sequence identity to *E. coli* gcvP. In some embodiments, the one or more nucleic acid molecule encoding an enzyme having glycine decarboxylase activity comprises an amino acid sequence set forth in UniProt ID P33195. In a further embodiment, the one or more nucleic acid molecule encoding an enzyme having glycine decarboxylase activity comprises a nucleic acid sequence set forth in Gene ID 947394. In some embodiments, the enzyme having aminomethyltransferase activity is encoded by an amino acid sequence having at least 70% sequence identity, having at least 80% sequence identity, or having at least 90% sequence identity to *E. coli* gcvT. In some embodiments, the one or more nucleic acid molecule encoding an enzyme having aminomethyltransferase activity comprises an amino acid sequence set forth in UniProt ID P27248. In a further embodiment, the one or more nucleic acid molecule encoding an enzyme having aminomethyltransferase activity comprises a nucleic acid sequence set forth in Gene ID 947390. In some embodiments, the enzyme having dihydrolipoamide dehydrogenase activity is encoded by an amino acid sequence having at least 70% sequence identity, having at least 80% sequence identity, or having at least 90% sequence identity to *E. coli* lpd (lpdA, E3 subunit). In some embodiments, the one or more nucleic acid molecule encoding an enzyme having dihydrolipoamide dehydrogenase activity comprises an amino acid sequence set forth in UniProt ID P0A9P0. In a further embodiment, the one or more nucleic acid molecule encoding an enzyme having dihydrolipoamide dehydrogenase activity comprises a nucleic acid sequence set forth in Gene ID 944854. In some embodiments, the H-protein is encoded by an amino acid sequence having at least 70% sequence identity, having at least 80% sequence identity, or having at least 90% sequence identity to *E. coli* gcvH. In some embodiments, the one or more nucleic acid molecule encoding an H-protein comprises an amino acid sequence set forth in UniProt ID P0A6T9. In a further embodiment, the one or more nucleic acid molecule encoding an H-protein is encoded by a nucleic acid sequence set forth in Gene ID 947393.

In some embodiments, an enzyme having glycolate dehydrogenase activity is used to convert glycolic acid to glyoxylate. In some embodiments, the enzyme having glycolate dehydrogenase activity is encoded by an amino acid sequence having at least 70% sequence identity, having at least 80% sequence identity, or having at least 90% sequence identity to an enzyme having glycolate dehydrogenase activity selected from *E. coli* glycolate dehydrogenase GLC and *Arabidopsis thaliana* glycolate dehydrogenase. In some embodiments, the one or more nucleic acid molecule encoding an enzyme or enzyme subunit associated with glycolate dehydrogenase activity comprises an amino acid sequence selected from UniProt ID P0AEP9, UniProt ID P52073, UniProt ID P52074, and UniProt ID Q94AX4. In a further embodiment, the one or more nucleic acid molecule encoding an enzyme or enzyme subunit associated with glycolate dehydrogenase activity comprises a nucleic acid sequence selected from Gene ID 947353, Gene ID 2847718, Gene ID 2847717, and GenBank accession Y13245.1.

In some embodiments, an enzyme having alanine-glyoxylate aminotransferase activity is used to convert glyoxylate to glycine. In some embodiments, the enzyme having alanine-glyoxylate aminotransferase activity is encoded by an amino acid sequence having at least 70% sequence identity, having at least 80% sequence identity, or having at least 90% sequence identity to an enzyme having alanine-glyoxylate aminotransferase activity selected from *Saccharomyces cerevisiae* AGX1, *Homo sapiens* AGXT2, *Arabidopsis thaliana* AOAT1 and *Arabidopsis thaliana* AOAT2. In some embodiments, the one or more nucleic acid molecule encoding an enzyme having alanine-glyoxylate aminotransferase activity comprises an amino acid sequence selected from UniProt ID P43567, UniProt ID Q9BYV1, UniProt ID Q9LR30 and UniProt ID Q9S7E9. In a further embodiment, the one or more nucleic acid molecule encoding an enzyme having alanine-glyoxylate aminotransferase activity comprises a nucleic acid sequence selected from Gene ID 850514, Gene ID 64902, TAIR accession AT1G23310 and TAIR accession AT1G70580.

In some embodiments, an enzyme having alanine transaminase activity is used to reconstitute alanine from pyruvate and glutamate. In some embodiments, the enzyme having alanine transaminase activity is encoded by an amino acid sequence having at least 70% sequence identity, having at least 80% sequence identity, or having at least 90% sequence identity to an enzyme having alanine transaminase activity selected from *E. coli* glutamate-pyruvate aminotransferase alaA, *E. coli* glutamate-pyruvate aminotransferase alaB, *E. coli* glutamate-pyruvate aminotransferase alaC, *Homo sapiens* alanine aminotransferase 1 (GPT), *Homo sapiens* alanine aminotransferase 2 (GPT2), *Arenicola marina* alanine transaminase, *Arabidopsis thaliana* tryptophan aminotransferase TAA1, *Arabidopsis thaliana* AOAT1, *Arabidopsis thaliana* AOAT2, *Candida maltose* alanine aminotransferase, *Clostridium propionicum* alanine aminotransferase, *Pyrococcus furiosus* alanine aminotransferase aat, *Megathyrsus maximus* alanine transaminase, and *Panicum miliaceum* alanine transaminase AlaAT-2. In some embodiments, the one or more nucleic acid molecule encoding an enzyme having alanine transaminase activity comprises an amino acid sequence selected from UniProt ID P0A959, UniProt ID P77434, UniProt ID P24298, UniProt ID Q8TD30, UniProt ID Q9S7N2, UniProt ID Q9LR30, UniProt ID Q9S7E9, UniProt ID Q9P9M8, and UniProt ID P34106. In a further embodiment, the one or more nucleic acid molecule encoding an enzyme having alanine transaminase activity comprises a nucleic acid sequence selected from Gene ID 946772, Gene ID 946850, Gene ID 2875, Gene ID 84706, Gene ID 843393, TAIR accession AT1G23310, TAIR accession AT1G70580, GenBank accession AF163769.1 and GenBank accession X69421.1.

In some embodiments, an enzyme having glutamate dehydrogenase activity is used to reconstitute glutamate from ammonia and 2-oxoglutarate. In some embodiments, the enzyme having glutamate dehydrogenase activity is encoded by an amino acid sequence having at least 70% sequence identity, having at least 80% sequence identity, or having at least 90% sequence identity to an enzyme having glutamate dehydrogenase activity selected from *Saccharomyces cerevisiae* NAD-dependent glutamate dehydrogenase GDH2, *Arabidopsis thaliana* NAD-dependent glutamate dehydrogenase GDH2, *Arabidopsis thaliana* NAD-dependent glutamate dehydrogenase GDH1, *Peptoniphilus asaccharolyticus* NAD-dependent glutamate dehydrogenase gdhA, *Halobacterium salinarum* NAD-dependent glutamate dehydrogenase gdhA, *Thermotoga maritima* glutamate dehydrogenase, *Homo sapiens* glutamate dehydrogenase 1 (GLUD1), *Homo sapiens* glutamate dehydrogenase 2 (GLUD2), *Bacillus subtilis* glutamate dehydrogenase and *Solanum lycopersicum* glutamate dehydrogenase GDH1. In some embodiments, the one or more nucleic acid molecule encoding an enzyme having glutamate dehydrogenase activity comprises an amino acid sequence selected from UniProt ID P33327, UniProt ID Q38946, UniProt ID Q38946, UniProt ID P28997, UniProt ID P29051, UniProt ID P00367, UniProt ID P49448 and UniProt ID P93541. In a further embodiment, the one or more nucleic acid molecule encoding an enzyme having glutamate dehydrogenase activity is encoded by a nucleic acid sequence selected from Gene ID 461927, TAIR accession AT5G07440, TAIR accession AT5G18170, GenBank accession M76403.1, GenBank accession X63837.1, Gene ID 2746, Gene ID 2747 and GenBank accession U48695.1.

Production of Monoethanolamine (MEA)

MEA can be produced via decarboxylation of Ser or transamination of glycolaldehyde.

In some preferred embodiments, serine decarboxylases are utilized, since they are found naturally, i.e. in choline biosynthesis pathways in plants, and the transamination of a glycolaldehyde intermediate would create a cross talk between the MEG and MEA pathway.

Alternatively, in another embodiment, MEA may be formed by ethanolamine ammonia lyase (EC 4.3.1.7) from acetaldehyde and ammonia:

Acetaldehyde+NH$_3$↔ethanolamine

In this case, MEA is not formed via the Ser biosynthesis pathway, but rather from acetyl-CoA and its reduction to acetaldehyde by acetaldehyde dehydrogenase. While the redox situation does not change, this pathway yields +1 ATP versus the Ser based pathway. It also avoids the toxic intermediate Ser, but has the toxic and volatile intermediate acetaldehyde.

In some embodiments, the production of MEG and MEA is very close to the thermodynamic maximum yield potential using the lossless conversion of one or more pentose and/or hexose sugars to D-ribose-5-phosphate intermediate, followed by the conversion of the D-ribose-5-phosphate intermediate to glycolaldehyde and D-glyceraldehyde-3-phosphate (G3P) intermediates, and then followed by the co-production of MEG via reduction of glycolaldehyde and MEA via one or more C3 pathways from the G3P intermediate. In some embodiments, the thermodynamic yield potential is 15% better for co-production of MEG and MEA via the pathways disclosed in the present application compared to production of MEA made from glucose by natural or published similar pathways.

Co-production, Ser pathway: (pentose or hexose)+
NH$_3$→MEG+MEA+0ATP*

Co-production, acetaldehyde pathway: (pentose or
hexose)+NH$_3$→MEG+MEA+1 ATP*

Y(pathway)=(0.371+0.365) g/g=0.736 g(MEG+MEA)/g
((pentose or hexose)+NH$_3$), 98% of Y(max)(heat of combustion)=0.749 g/g Standard pathway: glucose+2NH$_3$→2MEA+
2NADH+0 ATP Y(pathway)=0.570 g(MEA)/g(glucose+2NH$_3$), 85% of Y(max)(heat of combustion)=0.669 g/g

*Passive or H+ symport transport of D-xylose, a pentose, is assumed. Indirect ATP consumption for a H+ symporter or ATP required for cell maintenance are not accounted for.

In some embodiments, MEG and MEA are co-produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to MEA via one or more C3 pathways.

[U] In one embodiment, the application relates to a recombinant microorganism capable of co-producing monoethylene glycol (MEG) and MEA from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (i):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having 3-phosphoglycerate phosphatase activity and/or an enzyme having glycerate 3-kinase activity that catalyzes the conversion of 3-phosphoglycerate to glycerate;

(c) at least one endogenous or exogenous nucleic acid molecule encoding an enzyme having 2-phosphoglycerate phosphatase activity and/or an enzyme having glycerate 2-kinase activity that catalyzes the conversion of 2-phosphoglycerate to glycerate;

(d) at least one endogenous or exogenous nucleic acid molecule encoding an enzyme having phosphoserine aminotransferase activity that catalyzes the conversion of 3-phosphohydroxypyruvate from (a) to phospho-L-serine;

(e) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(f) at least one endogenous or exogenous nucleic acid molecule encoding an enzyme having phosphoserine phosphatase activity that catalyzes the conversion of phospho-L-serine from (d) to L-serine;

(g) at least one endogenous or exogenous nucleic acid molecule encoding an enzyme having hydroxypyruvate reductase activity that catalyzes the conversion of glycerate from (b) and/or (c) to hydroxypyruvate;

(h) at least one endogenous or exogenous nucleic acid molecule encoding an enzyme having serine-pyruvate aminotransferase activity that catalyzes the conversion of hydroxypyruvate from (e) and/or (g) to L-serine;

(i) at least one endogenous or exogenous nucleic acid molecule encoding an enzyme having serine decarboxylase activity that catalyzes the conversion of L-serine from (f) and/or (h) to MEA;

wherein the produced intermediate G3P from embodiment [A], from embodiment [B], or from embodiment [C] is converted to 3-phosphoglycerate and/or 2-phosphoglycerate through endogenous glycolysis in the microorganism, and wherein MEG and MEA are co-produced.

[V] In one embodiment, the application relates to a recombinant microorganism capable of co-producing monoethylene glycol (MEG) and MEA from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (f):

(a) at least one endogenous or exogenous nucleic acid molecule encoding an enzyme having 2-phosphoglycerate phosphatase activity and/or an enzyme having glycerate-2-kinase activity that catalyzes the conversion of 2-phosphoglycerate to glycerate;

(b) at least one endogenous or exogenous nucleic acid molecule encoding an enzyme having 3-phosphoglycerate phosphatase activity and/or an enzyme having glycerate-3-kinase activity that catalyzes the conversion of 3-phosphoglycerate to glycerate;

(c) at least one endogenous or exogenous nucleic acid molecule encoding an enzyme having hydroxypyruvate reductase activity that catalyzes the conversion of glycerate from (a) and/or (b) to hydroxypyruvate;

(d) at least one endogenous or exogenous nucleic acid molecule encoding an enzyme having serine-pyruvate aminotransferase or serine oxidoreductase (deaminating) activity that catalyzes the conversion of L-serine to hydroxypyruvate;

(e) at least one endogenous or exogenous nucleic acid molecule encoding an enzyme having hydroxypyruvate decarboxylase activity that catalyzes the conversion of hydroxypyruvate from (c) and/or (d) to glycolaldehyde;

(f) at least one endogenous or exogenous nucleic acid molecule encoding an enzyme having transaminase activity that catalyzes the conversion of glycolaldehyde from (e) to MEA;

wherein the produced intermediate G3P from embodiment [A] or from embodiment [B] is converted to 3-phosphoglycerate and/or 2-phosphoglycerate through endogenous glycolysis in the microorganism, and wherein MEG and MEA are co-produced.

[W] In one embodiment, the application relates to a recombinant microorganism capable of co-producing monoethylene glycol (MEG) and MEA from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (b):

(a) at least one endogenous or exogenous nucleic acid molecule encoding an enzyme having acetaldehyde dehydrogenase activity that catalyzes the conversion of acetyl-CoA to acetaldehyde;

(b) at least one endogenous or exogenous nucleic acid molecule encoding an enzyme having ethanolamine ammonia lyase activity that catalyzes the conversion of acetaldehyde and ammonia to MEA;

wherein the produced intermediate G3P from embodiment [A], from embodiment [B], or from embodiment [C] is converted to acetyl-CoA through endogenous glycolysis in the microorganism, and wherein MEG and MEA are co-produced.

In some embodiments, an enzyme having acetaldehyde dehydrogenase activity is used to reduce acetyl-CoA to acetaldehyde. In some embodiments, the enzyme having acetaldehyde dehydrogenase activity is encoded by an amino acid sequence having at least 70% sequence identity, having at least 80% sequence identity, or having at least 90% sequence identity to an enzyme having acetaldehyde dehydrogenase activity selected from *E. coli* mhpF, *E. coli* AdhE, *Chlamydomonas reinhardtii* ADH1, *Leuconostoc mesenteroides* CoA-dependent acetaldehyde dehydrogenase, *Pelobacter acetylenicus* acetaldehyde dehydrogenase, *Pseudomonas* sp. dmpF, *Pseudomonas putida* acylating aldehyde dehydrogenase todI, *Pseudomonas putida* acetaldehyde dehydrogenase cmtH and *Clostridium acetobutylicum* alcohol/aldehyde dehydrogenase AdhE. In some embodiments, the one or more nucleic acid molecule encoding an enzyme having acetaldehyde dehydrogenase activity comprises an amino acid sequence selected from UniProt ID P77580, UniProt P0A9Q7, UniProt ID A8J107, UniProt ID Q52060, UniProt ID Q51949 and UniProt ID P33744. In a further embodiment, the one or more nucleic acid molecule encoding an enzyme having acetaldehyde dehydrogenase activity comprises a nucleic acid sequence selected from Gene ID 945008, Gene ID 945837, Gene ID 5729132, GenBank accession X60835.1, GenBank accession U09250.1 and Gene ID 1116167.

In some embodiments, an enzyme having ethanolamine ammonia lyase activity is used to convert acetaldehyde and ammonia to MEA. In some embodiments, the enzyme having ethanolamine ammonia lyase activity is encoded by an amino acid sequence having at least 70% sequence identity, having at least 80% sequence identity, or having at least 90% sequence identity to an *E. coli* ethanolamine ammonia lyase. In some embodiments, the one or more nucleic acid molecule encoding an ethanolamine ammonia lyase subunit comprises an amino acid sequence selected from UniProt ID P0AEJ6 and UniProt ID P19636. In a further embodiment, the one or more nucleic acid molecule encoding an ethanolamine ammonia lyase subunit is encoded by a nucleic acid sequence selected from Gene ID 946924 and Gene ID 946925.

Production of Ethylenediamine (EDA)

Figure 7:
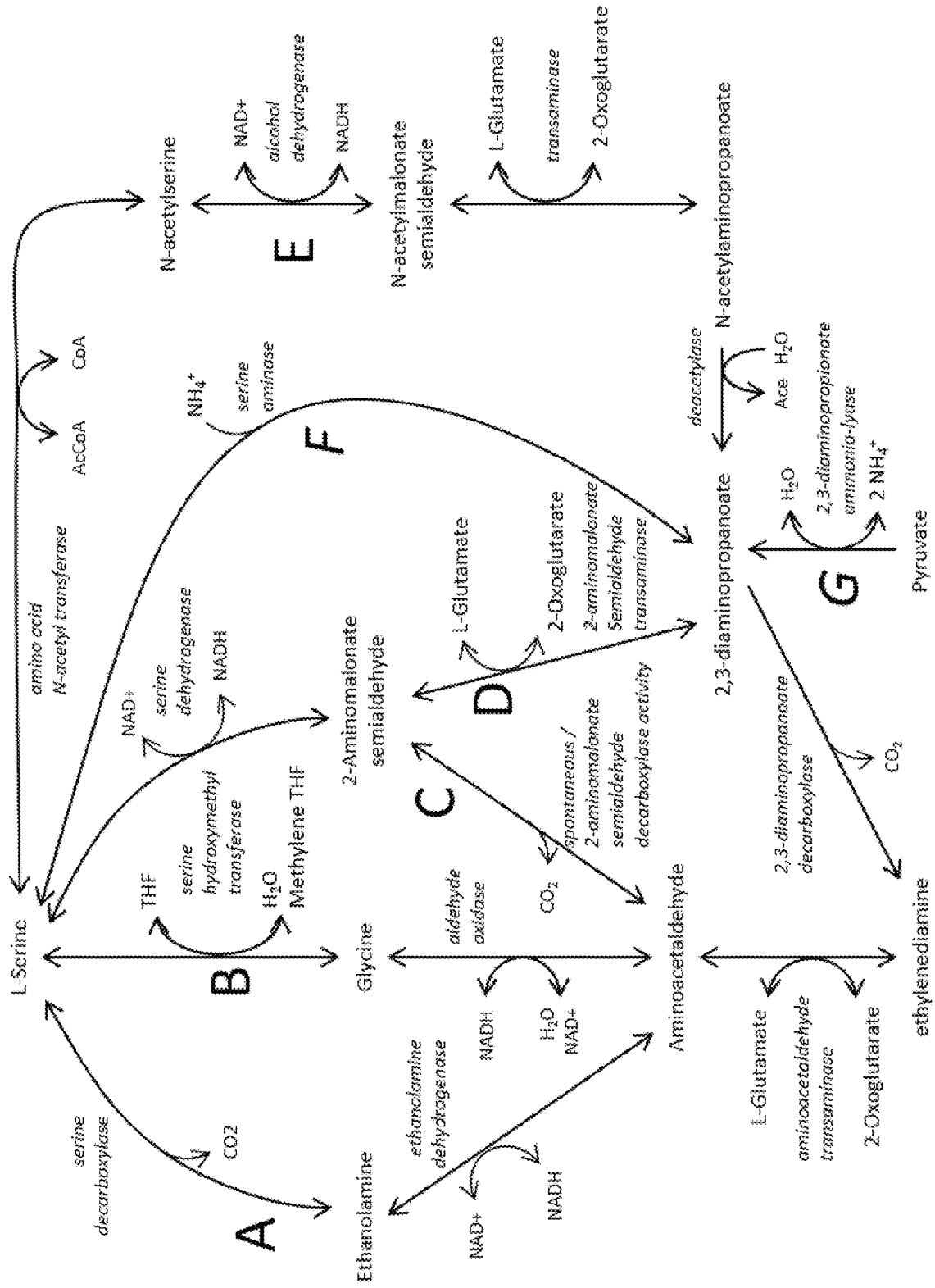
FIG. 7 illustrates published EDA production pathways. From WO 2014/049382. Reaction F: direct L-serine amination via L-serine aminase. Reaction G: direct pyruvate amination via 2,3-diaminopropionate ammonia lyase.

EDA can be produced by any of the pathways A through E described in WO 2014/049382, which is herein incorporated in its entirety (FIG. 7).

In some embodiments, MEG and EDA are co-produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to EDA via one or more C3 pathways.

[X] In one embodiment, the application relates to a recombinant microorganism capable of co-producing monoethylene glycol (MEG) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (c):

(a) at least one endogenous or exogenous nucleic acid molecule encoding an enzyme having serine dehydrogenase activity that catalyzes the conversion of L-serine to 2-aminomalonate semialdehyde;

(b) at least one endogenous or exogenous nucleic acid molecule encoding an enzyme having 2-aminomalonate semialdehyde decarboxylase activity that catalyzes the conversion of 2-aminomalonate semialdehyde from (a) to aminoacetaldehyde;

(c) at least one endogenous or exogenous nucleic acid molecule encoding an enzyme having aminoacetaldehyde transaminase activity that catalyzes the conversion of aminoacetaldehyde from (b) to EDA;

wherein 2-aminomalonate semialdehyde may optionally be converted to aminoacetaldehyde by a spontaneous reaction, and wherein MEG and EDA are co-produced.

According to this aspect of the disclosure, the recombinant microorganism overexpresses at least one of the genes encoding enzymes exhibiting activity of serine dehydrogenase and aminoacetaldehyde transaminase. These genes may be endogenous genes or exogenous genes.

The first reaction of the conversion of L-serine into 2-aminomalonate semialdehyde is catalysed by a serine dehydrogenase enzyme. This enzyme belongs to the large enzyme family of alcohol dehydrogenases also called aldehyde reductases. Several enzymes are known to exhibit serine dehydrogenase activity. In one embodiment of the disclosure, these enzymes are encoded by genes chosen among a list of genes well known in the art (Chowdhury et al., 1996, Yao et al., 2010, Tchigvintsev et al., 2012, Fujisawa et al., 2003, Hawes et al., 1996 and Lokanath et al., 2005), including but not limited to the genes listed here: mmsB from *Pseudomonas putida*, from *Synechococcus* PCC6301 or from *Bacillus cereus*; hibdh from *Pseudomonas putida* E23; PA0743 from *Pseudomonas aeruginosa*; ydfG from *Escherichia coli* or from *Bacillus brevis* or from *Bacillus subtilis*; sdh from *Agrobacterium tumefaciens*; hibadh from *Rattus norvegicus* or from *Thermus thermophilus* HB8; yiaY from *Escherichia coli*.

In a preferred embodiment of the disclosure, the serine dehydrogenase is encoded by ydfG from *Escherichia coli* or mmsB from *Pseudomonas putida*, or yiaY from *Escherichia coli*. Preferably, these enzymes are optimized by mutating the encoding genes in order to improve their catalytic efficiency of L-serine into 2-aminomalonate semialdehyde.

In another embodiment of the disclosure the serine dehydrogenase enzyme is obtained by evolving enzymes in order to modify their substrate specificity and/or their catalytic efficiency to obtain an enzyme which exhibits specificity for serine and activity of serine dehydrogenase. These enzymes are selected among the group of enzymes having the same type of catalytic activity on substrates chemically similar to L-serine. Preferably these enzymes may be chosen among 3-hydroxyisobutyrate dehydrogenases and serine dehydrogenases. More preferably they are encoded by genes chosen among a list of genes well known in the art, including but not limited to the genes here: gldA from *Escherichia coli* or from *Leuconostoc citreum* or from *Symbiobacterium thermophilum*; yqhE from *Escherichia coli*; yafB from *Escherichia coli*; alr from *Leishmania donovani*; sakR1 from *Synechococcus* sp.; yhdN from *Bacillus subtilis*, ytbE from

*Bacillus subtilis*, AKR4C9 from *Arabidopsis thaliana*, fucO from *Escherichia coli*. Any polypeptide having at least 90% sequence identity to any of the polypeptides encoded by these genes may be used.

Evolution of these enzymes is carried out by means and methods well known by one skilled in the art in order to obtain enzyme having improved specificity for the substrate L-serine and/or enabling to convert it into 2-aminomalonate semialdehyde with an improved activity. The selection of the evolved enzymes is performed by expressing the evolved enzymes in the microorganism of the disclosure or in vitro with L-serine as substrate and by detecting the product 2-aminomalonate semialdehyde.

The second reaction of the conversion of 2-aminomalonate semialdehyde into aminoacetaldehyde is performed spontaneously in the cell (Fujisawa et al., 2003). In another embodiment of the disclosure, the second reaction of conversion of 2-aminomalonate semialdehyde into aminoacetaldehyde is catalysed by an enzyme having 2-aminomalonate semialdehyde decarboxylase activity. This enzyme is not encountered naturally. Therefore it is obtained by evolution of known enzyme or by screening metagenomic libraries. The 2-aminomalonate semialdehyde decarboxylase activity is performed with an evolved amino acid decarboxylase or an evolved keto-acid decarboxylase which catalyses the decarboxylation of amino acids or keto acids. Preferably an evolved amino acid decarboxylase is chosen. More preferably the evolved amino acid decarboxylase is chosen among histidine decarboxylase, serine decarboxylase, aspartate decarboxylase, diaminobutanoate decarboxylase, ornithine decarboxylase. These enzymes are encoded by genes chosen among a list of genes well known in the art, including but not limited to the genes listed here: sdc from *Arabidopsis thaliana*, panD from *Aquifex aeolicus* or from *Bacillus subtilis*, GAD or GAD2 or GAD3 or GAD4 or GAD5 from *Arabidopsis thaliana*, GAD or GAD2 or OAZ1 or ODC1 from *Bos taurus*; gadA or gadB or panD or speC or speF from *Escherichia coli*; SCC105.13 from *Streptomyces coelicolor*, gadB from *Mannheimia succiniciproducens*; bdb from *Haloferax volcanii*, odc1 from *Lactobacillus* sp.; kivD from *Lactococcus lactis* subsp. *Lactis*; kdcA from *Lactococcus lactis*, OAZ1 or ODC1 from *Bos taurus*; speC or speF from *Escherichia coli*; SPE1 from *Saccharomyces cerevisiae*. Any polypeptide having at least 90% sequence identity to any of the polypeptides encoded by these genes may be used. Preferably, the sdc gene from *Arabidopsis thaliana* is used for obtaining the 2-aminomalonate semialdehyde decarboxylase activity.

Evolution of these enzymes is carried out by means and methods well known by one skilled in the art in order to obtain enzymes having specificity for the substrate 2-aminomalonate semialdehyde and enabling to convert it into aminoacetaldehyde. The selection of the evolved enzyme is performed by expressing the evolved enzyme in the microorganism of the invention or in vitro with 2-aminomalonate semialdehyde as substrate and by quantifying the product aminoacetaldehyde.

The last reaction of the conversion of aminoacetaldehyde into ethylenediamine is catalysed by an aminoacetaldehyde transaminase. This enzyme is not encountered naturally. Therefore it is obtained by evolution of a known enzyme or by screening metagenomic libraries. In one embodiment of the invention, the aminoacetaldehyde transaminase activity is performed with an evolved transaminase or aminotransferase which catalyses the exchange of an amino group of one molecule with an oxo group on another molecule. Preferably, the evolved aminotransferase is chosen among phosphoserine aminotransferase or aspartate aminotransferase or glutamate aminotransferase. More preferably, the evolved aminotransferase is chosen among aminotransferases using glutamate as amino group donor. These enzymes are encoded by genes chosen among a list of genes well known in the art, including but not limited to the genes listed here: serC from *Escherichia coli* or from *Bacillus subtilis* or from *Corynebacterium glutamicum*, GOT1 from *Sus scrofa*; patA from *Escherichia coli*; ygjG from *Brucella canis*; rocD from *Rhizobium* NGR 234 or from *Streptomyces avermitilis*, SCO1284 from *Streptomyces coelicolor*, AGT or AGT2 or AGT3 or GGT1 from *Arabidopsis thaliana*, AGXT from *Bos taurus*. Any polypeptide having at least 90% sequence identity to any of the polypeptides encoded by these genes may be used. Preferably, genes serC from *Escherichia coli* or GOT1 from *Sus scrofa* are used for obtaining the aminoacetaldehyde transaminase activity.

Evolution of these enzymes is carried out by means and methods well known by one skilled in the art in order to obtain enzymes having specificity for the substrate aminoacetaldehyde and enabling to convert it into ethylenediamine. The selection of the evolved enzyme is done by expressing the evolved enzyme in the microorganism of the invention or in vitro with aminoacetaldehyde as substrate and by detecting the product ethylenediamine.

In another embodiment of the disclosure, aminoacetaldehyde transaminase enzymes can be isolated from strains growing on ethylenediamine as sole carbon and nitrogen source. For this purpose enrichment cultures from environmental samples on ethylenediamine are cultivated on minimal medium with ethylenediamine as sole nitrogen and carbon source. Metagenomic libraries are generated from these cultures and screened for the presence of aminoacetaldehyde transaminase enzymes. This approach allows isolating the gene corresponding to the enzymatic activity and is well-known to the expert in the field.

According to a specific aspect of the disclosure, the microorganism from embodiment [X] is engineered to overexpress at least one of the following genes: ydfG gene or mmsB gene or yiaY gene, encoding for the serine dehydrogenase; and/or an evolved serC gene or GOT1 gene, encoding for the aminoacetaldehyde transaminase activity.

[Y] In one embodiment, the application relates to a recombinant microorganism capable of co-producing monoethylene glycol (MEG) (or glycolic acid) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (c):

(a) at least one endogenous or exogenous nucleic acid molecule encoding an enzyme having serine dehydrogenase activity that catalyzes the conversion of L-serine to 2-aminomalonate semialdehyde;

(b) at least one endogenous or exogenous nucleic acid molecule encoding an enzyme having 2-aminomalonate semialdehyde transaminase activity that catalyzes the conversion of 2-aminomalonate semialdehyde from (a) to 2,3-diaminopropanoate;

(c) at least one endogenous or exogenous nucleic acid molecule encoding an enzyme having 2,3-diaminopropanoate decarboxylase activity that catalyzes the conversion of 2,3-diaminopropanoate from (b) to EDA;
wherein MEG and EDA are co-produced.

According to this aspect of the disclosure, the recombinant microorganism overexpresses at least one of the genes encoding enzymes exhibiting activity of serine dehydrogenase, 2-aminomalonate semialdehyde transaminase and 2,3-diaminopropanoate decarboxylase. These genes may be endogenous genes or exogenous genes.

The first reaction of conversion of L-serine into 2-aminomalonate semialdehyde is catalysed by a serine dehydrogenase enzyme. This enzyme belongs to the large enzyme family of alcohol dehydrogenases also called aldehyde reductases. Several enzymes are known to exhibit serine dehydrogenase activity. In one embodiment of the disclosure, the serine dehydrogenase is chosen among these known enzymes. These enzymes are encoded by genes chosen among a list of genes well known in the art (Chowdhury et al., 1996, Yao et al., 2010, Tchigvintsev et al., 2012, Fujisawa et al., 2003, Hawes et al., 1996 and Lokanath et al., 2005), including but not limited to the genes listed here: mmsB from *Pseudomonas putida*, from *Synechococcus* PCC6301 or from *Bacillus cereus*; hibdh from *Pseudomonas putida* E23; PA0743 from *Pseudomonas aeruginosa*; ydfG from *Escherichia coli* or from *Bacillus brevis* or from *Bacillus subtilis*; sdh from *Agrobacterium tumefaciens*; hibadh from *Rattus norvegicus* or from *Thermus thermophilus* HB8; yiaY from *Escherichia coli*.

In a preferred embodiment of the disclosure, the serine dehydrogenase is encoded by ydfG from *Escherichia coli* or mmsB from *Pseudomonas putida*, or yiaY from *Escherichia coli*. Preferably, these enzymes are optimized by mutating the encoding genes in order to improve their catalytic efficiency of L-serine into 2-aminomalonate semialdehyde.

In another embodiment of the disclosure the serine dehydrogenase enzyme is obtained by evolving enzymes in order to modify their substrate specificity and/or their catalytic efficiency to obtain an enzyme which exhibits specificity for serine and activity of serine dehydrogenase. These enzymes are selected among the group of enzymes having the same type of catalytic activity on substrates chemically similar to L-serine. Preferably these enzymes may be chosen among 3-hydroxyisobutyrate dehydrogenases and serine dehydrogenases. More preferably they are encoded by genes chosen among a list of genes well known in the art, including but not limited to the genes here: gldA from *Escherichia coli* or from *Leuconostoc citreum* or from *Symbiobacterium thermophilum*; yqhE from *Escherichia coli*; yafB from *Escherichia coli*; alr from *Leishmania donovani*; sakR1 from *Synechococcus* sp.; yhdN from *Bacillus subtilis*; ytbE from *Bacillus subtilis*; AKR4C$_9$ from *Arabidopsis thaliana*; fucO from *Escherichia coli*. Any polypeptide having at least 90% sequence identity to any of the polypeptides encoded by these genes may be used.

Evolution of these enzymes is carried out by means and methods well known by one skilled in the art in order to obtain enzyme having improved specificity for the substrate L-serine and/or enabling to convert it into 2-aminomalonate semialdehyde with an improved activity. The selection of the evolved enzymes is performed by expressing the evolved enzymes in the microorganism of the disclosure or in vitro with L-serine as substrate and by detecting the product 2-aminomalonate semialdehyde.

The second reaction of conversion of 2-aminomalonate semialdehyde into 2,3-diaminopropanoate is catalysed by a 2-aminomalonate semialdehyde transaminase. This enzyme is not encountered naturally. Therefore it is obtained by evolution of a known enzyme or by screening metagenomic libraries. The 2-aminomalonate semialdehyde transaminase activity is performed with an evolved transaminase or aminotransferase which catalyses the exchange of an amino group of one molecule with an oxo group of another molecule. Preferably the evolved aminotransferase is chosen among phosphoserine aminotransferase or aspartate aminotransferase or glutamate aminotransferase. More preferably, the evolved aminotransferase is chosen among aminotransferase using glutamate as amino group donor. These enzymes are encoded by genes chosen among a list of genes well known in the art, including but not limited to the genes listed here: serC from *Escherichia coli* or from *Bacillus subtilis* or from *Corynebacterium glutamicum*, GOT1 from *Sus scrofa*; patA from *Escherichia coli*; ygjG from *Brucella canis*; rocD from *Rhizobium* NGR 234 or from *Streptomyces avermitilis*, SCO1284 from *Streptomyces coelicolor*, AGT or AGT2 or AGT3 or GGT1 from *Arabidopsis thaliana*, AGXT from *Bos taurus*. Any polypeptide having at least 90% sequence identity to any of the polypeptides encoded by these genes may be used. Preferably, genes serC from *Escherichia coli* or GOT1 from *Sus scrofa* are used for obtaining the 2-aminomalonate semialdehyde transaminase activity.

Evolution of these enzymes is carried out by means and methods well known by the man skilled in the art in order to obtain enzymes having improved specificity for the substrate 2-aminomalonate semialdehyde and/or enabling to convert it into 2,3-diaminopropanoate with an improved activity. The selection of the evolved enzyme is done by expressing the evolved enzyme in the microorganism of the invention or in vitro with 2-aminomalonate semialdehyde as substrate and by quantifying the product 2,3-diaminopropanoate.

The third reaction of conversion of 2,3-diaminopropanoate into ethylenediamine is catalysed by an enzyme having 2,3-diaminopropanoate decarboxylase activity. This enzyme is not encountered naturally. Therefore it is obtained by evolution of known enzyme or by screening metagenomic libraries. The 2,3-diaminopropanoate decarboxylase activity is performed with an evolved amino acid decarboxylase or an evolved keto-acid decarboxylase which catalyses the decarboxylation of amino acids or keto-acids. Preferably an evolved amino acid decarboxylase is chosen. More preferably the evolved amino acid decarboxylase is chosen among histidine decarboxylase, serine decarboxylase, aspartate decarboxylase, diaminobutanoate decarboxylase, ornithine decarboxylase. These enzymes are encoded by genes chosen among a list of genes well known in the art, including but not limited to the genes listed here: sdc from *Arabidopsis thaliana*; padC or yclB from *Bacillus subtilis*; ubiD from *Campylobacter jejuni* or from *Escherichia coli*; PAD1 or GAD1 or SPE1 from *Saccharomyces cerevisiae*; panD from *Aquifex aeolicus* or from *Bacillus subtilis*; GAD or GAD2 or GAD3 or GAD4 or GAD5 from *Arabidopsis thaliana*; GAD or GAD2 or OAZ1 or ODC1 from *Bos taurus*; gadA or gadB or panD or speC or speF from *Escherichia coli*; SCC105.13 from *Streptomyces coelicolor*, gadB from *Mannheimia succiniciproducens*; bdb from *Haloferax volcanii*; odd from *Lactobacillus* sp.; kivD from *Lactococcus lactis* subsp. *Lactis*; kdcA from *Lactococcus lactis*; OAZ1 or ODC1 from *Bos taurus*; speC or speF from *Escherichia coli*; SPE1 from *Saccharomyces cerevisiae*. Any polypeptide having at least 90% sequence identity to any of the polypeptides encoded by these genes may be used. Preferably, the sdc gene from

*Arabidopsis thaliana* is used for obtaining the 2,3-diaminopropanoate decarboxylase activity.

Evolution of these enzymes is carried out by means and methods well known by the man skilled in the art in order to obtain enzymes having improved specificity for the substrate 2,3-diaminopropanoate and/or enabling to convert it into ethylenediamine with an improved activity. The selection of the evolved enzyme is performed by expressing the evolved enzyme in the microorganism of the invention or in vitro with 2,3-diaminopropanoate as substrate and by quantifying the product ethylenediamine. According to a specific aspect of the disclosure, the microorganism from embodiment [Y] is engineered to overexpress: ydfG gene, yiaY gene or mmsB gene, encoding for the serine dehydrogenase; and/or evolved serC gene or GOT1 gene, encoding for 2-aminomalonate semialdehyde transaminase activity; and/or evolved sdc gene from *Arabidopsis thaliana*, coding for the 2,3-diaminopropanoate decarboxylase.

[Z] In one embodiment, the application relates to a recombinant microorganism capable of co-producing monoethylene glycol (MEG) (or glycolic acid) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (c):

(a) at least one endogenous or exogenous nucleic acid molecule encoding an enzyme having serine decarboxylase activity that catalyzes the conversion of L-serine to ethanolamine;

(b) at least one endogenous or exogenous nucleic acid molecule encoding an enzyme having ethanolamine dehydrogenase activity that catalyzes the conversion of ethanolamine from (a) to aminoacetaldehyde;

(c) at least one endogenous or exogenous nucleic acid molecule encoding an enzyme having aminoacetaldehyde transaminase activity that catalyzes the conversion of aminoacetaldehyde from (b) to EDA;

wherein MEG and EDA are co-produced.

According to this aspect of the disclosure, the recombinant microorganism overexpresses at least one of the genes encoding enzymes exhibiting activity of serine decarboxylase, ethanolamine dehydrogenase and aminoacetaldehyde transaminase. These genes may be endogenous genes or exogenous genes.

The first reaction of conversion of L-serine into ethanolamine is catalyzed by an enzyme having serine decarboxylase activity. This group of enzymes catalyses the decarboxylation of L-serine into ethanolamine. In a preferred embodiment of the invention, the serine decarboxylase is encoded by sdc from *Arabidopsis thaliana* (Rontein et al., 2001, WO2007/144346). The conversion of L-serine into ethanolamine by the serine decarboxylase, encoded by sdc from *Arabidopsis thaliana*, is disclosed in particular in patent application WO2007/144364, which is incorporated by reference herein. Preferably, these enzymes are optimized by mutating the encoding genes in order to improve their conversion efficiency of L-serine into ethanolamine.

In one embodiment of the disclosure, the serine decarboxylase activity is obtained by evolving enzymes in order to modify their substrate specificity and/or their catalytic efficiency to obtain an enzyme which exhibits specificity for serine and improved activity of serine decarboxylase. These enzymes are selected among the group of enzymes having the same type of catalytic activity on substrates chemically similar to ethanolamine. These enzymes are encoded by genes chosen among a list of genes well known in the art, including but not limited to the genes listed here: GAD1 or SPE1 from *Saccharomyces cerevisiae*; panD from *Aquifex aeolicus* or from *Bacillus subtilis*; GAD or GAD2 or GAD3 or GAD4 or GAD5 from *Arabidopsis thaliana*; GAD or GAD2 or OAZ1 or ODC1 from *Bos taurus*; gadA or gadB or panD or speC or speF from *Escherichia coli*; SCC105.13 from *Streptomyces coelicolor*, gadB from *Mannheimia succiniciproducens*; bdb from *Haloferax volcanii*; odc1 from *Lactobacillus* sp.; OAZ1 or ODC1 from *Bos taurus*; speC or speF from *Escherichia coli*; SPE1 from *Saccharomyces cerevisiae*. Any polypeptide having at least 90% sequence identity to any of the polypeptides encoded by those genes may be used.

Evolution of these enzymes is carried out by means and methods well known by one skilled in the art in order to obtain enzymes having improved specificity for the substrate L-serine and enabling to convert it into ethanolamine with an improved activity. The selection of the evolved enzyme is performed by expressing the evolved enzyme in the microorganism of the invention or in vitro with L-serine as substrate and by quantifying the product ethanolamine.

The second reaction of conversion of ethanolamine into aminoacetaldehyde is catalysed by an ethanolamine dehydrogenase enzyme. Natural enzymes having this activity are not disclosed in prior art; however some enzymes have low catalytic activity. Therefore it is advantageous to evolve these enzymes with low catalytic activity towards evolved enzymes with improved activity. Useful enzymes can also be obtained by screening metagenomic libraries.

In one embodiment of the disclosure, the ethanolamine dehydrogenase activity is obtained by evolving enzymes in order to modify their substrate specificity and/or their catalytic efficiency to obtain an enzyme which exhibits specificity for ethanolamine and activity of ethanolamine dehydrogenase. These enzymes are selected among the group of enzymes having the same type of catalytic activity on substrates chemically similar to ethanolamine. These enzymes are encoded by genes chosen among a list of genes well known in the art, including but not limited to the genes listed here: mmsB from *Pseudomonas putida*, or from *Synechococcus* PCC6301, or from *Bacillus cereus*; hibdh from *Pseudomonas putida* E23; PA0743 from *Pseudomonas aeruginosa*; ydfG from *Escherichia coli* or from *Bacillus brevis* or from *Bacillus subtilis*; sdh from *Agrobacterium tumefaciens*; hibadh from *Rattus norvegicus* or from *Thermus thermophilus* H B8; gldA from *Escherichia coli* or from *Leuconostoc citreum* or from *Symbiobacterium thermophilum*; yqhE from *Escherichia coli*; yafB from *Escherichia coli*; aladh from *Enterobacter aerogenes*; alr from *Leishmania donovani*; sakR1 from *Synechococcus* sp.; yhdN from *Bacillus subtilis*; ytbE from *Bacillus subtilis*; yiaY from *Escherichia coli*; AKR4C9 from *Arabidopsis thaliana*; fucO from *Escherichia coli*. Any polypeptide having at least 90% sequence identity to any of the polypeptides encoded by these genes may be used. Preferably genes fucO from *Escherichia coli* or yiaY from *Escherichia coli* are used for obtaining the ethanolamine dehydrogenase activity.

Evolution of these enzymes is carried out by means and methods well known by one skilled in the art in order to obtain enzymes having improved specificity for the substrate ethanolamine and/or enabling to convert it into aminoacetaldehyde with an improved activity. The selection of evolved enzymes is done by expressing the evolved enzymes in the microorganism of the invention or in vitro with ethanolamine as substrate and by quantifying the product aminoacetaldehyde.

The last reaction of conversion of aminoacetaldehyde into ethylenediamine is catalysed by an aminoacetaldehyde transaminase. This enzyme is not encountered naturally. Therefore it is obtained by evolution of known enzyme or by screening metagenomic libraries. In one embodiment of the disclosure, the aminoacetaldehyde transaminase activity is performed with an evolved transaminase or aminotransferase which catalyses the exchange of an amino group of one molecule with an oxo group on another molecule. Preferably, the evolved aminotransferase is chosen among phosphoserine aminotransferase or aspartate aminotransferase or glutamate aminotransferase. More preferably the evolved aminotransferase is chosen among aminotransferase using glutamate as amino group donor. These enzymes are encoded by genes chosen among a list of genes well known in the art, including but not limited to the genes listed here: serC from *Escherichia coli* or from *Bacillus subtilis* or from *Corynebacterium glutamicum*; GOT1 from *Sus scrofa*; patA from *Escherichia coli*; ygjG from *Brucella canis*; rocD from *Rhizobium* NGR 234 or from *Streptomyces avermitilis*; SCO1284 from *Streptomyces coelicolor*, AGT or AGT2 or AGT3 or GGT1 from *Arabidopsis thaliana*; AGXT from *Bos taurus*. Any polypeptide having at least 90% sequence identity to any of the polypeptides encoded by these genes may be used. Preferably, genes serC from *Escherichia coli* or GOT1 from *Sus scrofa* are used.

Evolution of these enzymes is carried out by means and methods well known by one skilled in the art in order to obtain enzymes having improved specificity for the substrate aminoacetaldehyde and/or enabling to convert it into ethylenediamine with an improved activity. The selection of the evolved enzyme is done by expressing the evolved enzyme in the microorganism of the invention or in vitro with aminoacetaldehyde as substrate and by detecting the product ethylenediamine.

In another embodiment of the disclosure, aminoacetaldehyde transaminase enzymes can be isolated from strains growing on ethylenediamine as sole carbon and nitrogen source. For this purpose enrichment cultures from environmental samples on ethylenediamine are cultivated on minimal medium with ethylenediamine as sole nitrogen and carbon source. Metagenomic libraries are generated from these cultures and screened for the presence of aminoacetaldehyde transaminase enzymes. This approach allows isolating the gene corresponding to the enzymatic activity and is well-known to the expert in the field.

According to a specific aspect of the disclosure, the microorganism from embodiment [Z] is engineered to overexpress: an sdc gene from *Arabidopsis thaliana*, encoding a serine decarboxylase; and/or fucO or yiaY genes from *Escherichia coli*, encoding for the ethanolamine dehydrogenase activity; and/or an evolved serC gene or GOT1 gene, encoding for aminoacetaldehyde transaminase activity.

[AA] In one embodiment, the application relates to a recombinant microorganism capable of co-producing monoethylene glycol (MEG) (or glycolic acid) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (c):

(a) at least one endogenous or exogenous nucleic acid molecule encoding an enzyme having serine hydroxymethyltransferase activity that catalyzes the conversion of L-serine to glycine;

(b) at least one endogenous or exogenous nucleic acid molecule encoding an enzyme having aldehyde oxidase activity that catalyzes the conversion of glycine from (a) to aminoacetaldehyde;

(c) at least one endogenous or exogenous nucleic acid molecule encoding an enzyme having aminoacetaldehyde transaminase activity that catalyzes the conversion of aminoacetaldehyde from (b) to EDA;

wherein MEG and EDA are co-produced.

Preferably gene glyA from *Escherichia coli* is used for obtaining the serine hydroxymethyltransferase activity.

The aldehyde oxidase enzyme is obtained by evolving enzymes in order to modify their substrate specificity and/or their catalytic efficiency to obtain an enzyme which exhibits specificity for glycine and activity of aldehyde oxidase. These enzymes are selected among the group of enzymes having the same type of catalytic activity on substrates chemically similar to glycine. These enzymes are encoded by genes chosen among a list of genes well known in the art, including but not limited to the genes listed here: aldH1 from *Aquifex aeolicus*, dhaS from *Anoxybacillus flavithermus*; Aldh from *Apis mellifera*, aldX, aldY, dhaS, ycbD, yfmT or ywdH from *Bacillus subtilis*, prr from *Escherichia coli*; ALD2, ALD3, ALD4, ALD5, ALD6 from *Saccharomyces cerevisiae*; betB from *Roseobacter denitrificans*; AAur_0650 from *Arthrobacter aurescens*. Any polypeptide having at least 90% sequence identity to any of the polypeptides encoded by these genes may be used.

Conversion of aminoacetaldehyde into ethylenediamine by an enzyme having aminoacetaldehyde transaminase activity. This enzyme is obtained by evolving enzymes in order to modify their substrate specificity and/or their catalytic efficiency to obtain an enzyme which exhibits specificity for aminoacetaldehyde and activity of transaminase. These enzymes are selected among the group of enzymes having the same type of catalytic activity on substrates chemically similar to aminoacetaldehyde. These enzymes are encoded by genes chosen among a list of genes well known in the art, including but not limited to the genes listed here: serC from *Escherichia coli* or from *Bacillus subtilis* or from *Corynebacterium glutamicum*; GOT1 from *Sus scrofa*; patA from *Escherichia coli*; ygjG from *Brucella canis*; rocD from *Rhizobium* NGR 234 or from *Streptomyces avermitilis*, SCO1284 from *Streptomyces coelicolor*, AGT or AGT2 or AGT3 or GGT1 from *Arabidopsis thaliana*; AGXT from *Bos taurus*. Any polypeptide having at least 90% sequence identity to any of the polypeptides encoded by these genes may be used.

According to a specific aspect of the disclosure, the microorganism from embodiment [AA] is engineered to overexpress an evolved serC gene or GOT1 gene, encoding for aminoacetaldehyde transaminase activity.

[BB] In one embodiment, the application relates to a recombinant microorganism capable of co-producing monoethylene glycol (MEG) (or glycolic acid) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (e):

(a) at least one endogenous or exogenous nucleic acid molecule encoding an enzyme having an amino acid N-acetyl transferase activity or O-acetyl transferase activity that catalyzes the conversion of L-serine to N-acetylserine;

(b) at least one endogenous or exogenous nucleic acid molecule encoding an enzyme having N-acetylserine dehydrogenase activity that catalyzes the conversion of N-acetylserine from (a) to N-acetylmalonate semialdehyde;

(c) at least one endogenous or exogenous nucleic acid molecule encoding an enzyme having transaminase activity that catalyzes the conversion of N-acetylmalonate semialdehyde from (b) to acetylaminopropanoate;

(d) at least one endogenous or exogenous nucleic acid molecule encoding an enzyme having deacetylase activity that catalyzes the conversion of acetylaminopropanoate from (c) to 2,3-diaminopropanoate;

(e) at least one endogenous or exogenous nucleic acid molecule encoding an enzyme having 2,3-diaminopropanoate decarboxylase activity that catalyzes the conversion of 2,3-diaminopropanoate from (d) to EDA;

wherein MEG and EDA are co-produced.

The first conversion step of embodiment [BB] may be an amino acid N-acetyl transferase activity or O-acetyl transferase activity, since the transformation of 0 to N is spontaneous. Preferably gene argA from *Escherichia coli* is used for obtaining the amino acid N-acetyl transferase activity.

An enzyme having N-acetylserine dehydrogenase activity is obtained by evolving enzymes in order to modify their substrate specificity and/or their catalytic efficiency to obtain an enzyme which exhibits specificity for N-acetylserine and activity of N-acetylserine dehydrogenase. These enzymes are selected among the group of enzymes having the same type of catalytic activity on substrates chemically similar to N-acetylserine. These enzymes are encoded by genes chosen among a list of genes well known in the art, including but not limited to the genes listed here: mmsB from *Pseudomonas putida*, or from *Synechococcus* PCC6301, or from *Bacillus cereus*; hibdh from *Pseudomonas putida* E23; PA0743 from *Pseudomonas aeruginosa*; ydfG from *Escherichia coli* or from *Bacillus brevis* or from *Bacillus subtilis*, sdh from *Agrobacterium tumefaciens*; hibadh from *Rattus norvegicus* or from *Thermus thermophilus* HB8; gldA from *Escherichia coli* or from *Leuconostoc citreum* or from *Symbiobacterium thermophilum*, yqhE from *Escherichia coli*; yafB from *Escherichia coli*; aladh from *Enterobacter aerogenes*; alr from *Leishmania donovani*; sakR1 from *Synechococcus* sp.; yhdN from *Bacillus subtilis*, ytbE from *Bacillus subtilis*, yiaY from *Escherichia coli*; AKR4C9 from *Arabidopsis thaliana*, fucO from *Escherichia coli*. Any polypeptide having at least 90% sequence identity to any of the polypeptides encoded by these genes may be used.

An enzyme having a transaminase activity to convert N-acetylmalonate semialdehyde to acetylaminopropanoate may be obtained by evolving enzymes in order to modify their substrate specificity and/or their catalytic efficiency to obtain an enzyme which exhibits specificity for N-acetylmalonate semialdehyde and activity of N-acetylmalonate semialdehyde transaminase. These enzymes are selected among the group of enzymes having the same type of catalytic activity on substrates chemically similar to N-acetylmalonate semialdehyde. These enzymes are encoded by genes chosen among a list of genes well known in the art, including but not limited to the genes listed here: serC from *Escherichia coli* or from *Bacillus subtilis* or from *Corynebacterium glutamicum*; GOT1 from *Sus scrofa*; patA from *Escherichia coli*; ygjG from *Brucella canis*; rocD from *Rhizobium* NGR 234 or from *Streptomyces avermitilis*; 2SCG18.31c from *Streptomyces coelicolor*, AGT or AGT2 or AGT3 or GGT1 from *Arabidopsis thaliana*; AGXT from *Bos taurus*. Any polypeptide having at least 90% sequence identity to any of the polypeptides encoded by these genes may be used.

Preferably gene argE from *Escherichia coli* is used for obtaining the deacetylase activity to convert acetylaminopropanoate into 2,3-diaminopropanoate.

An enzyme having amino-acid decarboxylase activity or keto acid decarboxylase activity to convert 2,3-diaminopropanoate into ethylenediamine may be obtained by evolving enzymes in order to modify their substrate specificity and/or their catalytic efficiency to obtain an enzyme which exhibits specificity for 2,3-diaminopropanoate and activity of amino acid decarboxylase or keto acid decarboxylase. These enzymes are selected among the group of enzymes having the same type of catalytic activity on substrates chemically similar to 2,3-diaminopropanoate. These enzymes are encoded by gene chosen among a list of genes well known in the art, including but not limited to the genes listed here: sdc from *Arabidopsis thaliana*; padC or yclB from *Bacillus subtilis*; ubiD from *Campylobacter jejuni* or from *Escherichia coli*; PAD1 or GAD1 or SPE1 from *Saccharomyces cerevisiae*; panD from *Aquifex aeolicus* or from *Bacillus subtilis*; GAD or GAD2 or GAD3 or GAD4 or GAD5 from *Arabidopsis thaliana*; GAD or GAD2 or OAZ1 or ODC1 from *Bos taurus*; gadA or gadB or panD or speC or speF from *Escherichia coli*; SCC105.13 from *Streptomyces coelicolor*, gadB from *Mannheimia succiniciproducens*; bdb from *Haloferax volcanii*; odd from *Lactobacillus* sp.; kivD from *Lactococcus lactis* subsp. *Lactis*; kdcA from *Lactococcus lactis*; OAZ1 or ODC1 from *Bos taurus*; speC or speF from *Escherichia coli*; SPE1 from *Saccharomyces cerevisiae*. Any polypeptide having at least 90% sequence identity to any of the polypeptides encoded by these genes may be used.

In a further embodiment of the disclosure, the method is performed with a microorganism wherein serine biosynthesis is optimized. This optimization is disclosed in particular in patent application WO 2007/144346, which is incorporated by reference herein.

Alternatively, in another embodiment, EDA can be produced by the following process: Ser can be directly aminated to (S)-2,3-diaminopropanoate by serine aminase (EC 2.6.1.-), then decarboxylated to EDA, for instance by an enzyme from the family of L-2,4-diaminobutyrate or ornithine decarboxylases (FIG. 7). However, if such an enzyme with (S)-2,3-diaminopropanoate decarboxylase activity is not specific, it may also act on other amino acids or serine itself.

In some embodiments, EDA can be produced by the following process: the intermediate (S)-2,3-diaminopropanoate may also be produced by direct amination of pyruvate using (S)-2,3-diaminopropanoate ammonia lyase (EC 4.3.1.15) (FIG. 7):

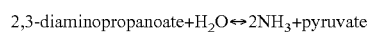

2,3-diaminopropanoate+H$_2$O↔2NH$_3$+pyruvate

In some embodiments, the production of MEG and EDA is very close to the thermodynamic maximum yield potential using the lossless conversion of one or more pentose and/or hexose sugars to D-ribose-5-phosphate intermediate, followed by the conversion of the D-ribose-5-phosphate intermediate to glycolaldehyde and D-glyceraldehyde-3-phosphate (G3P) intermediates, and then followed by the co-production of MEG via reduction of glycolaldehyde and EDA via one or more C3 pathways from the G3P intermediate. In some embodiments, the thermodynamic yield potential is 14% better for co-production of MEG and EDA via the pathways disclosed in the present application compared to production of EDA made from glucose by natural or published similar pathways.

Co-production: (pentose or hexose)+2NH$_3$→MEG+ EDA+0 ATP*

Y(pathway)=(0.337+0.326) g/g=0.663 g(MEG+EDA)/g ((pentose or hexose)+2NH$_3$), 97% of Y(max)(heat of combustion)=0.687 g/g Standard pathway: glucose+4 NH$_3$→2 EDA+2 NADH+0 ATP Y(pathway)=0.484 g(EDA)/g(glucose+4NH$_3$), 85% of Y(max)(heat of combustion)=0.571 g/g

*Passive or H+ symport transport of D-xylose, a pentose, is assumed. Indirect ATP consumption for a H+ symporter or ATP required for cell maintenance are not accounted for.

[CC] In one embodiment, the application relates to a recombinant microorganism capable of co-producing monoethylene glycol (MEG) (or glycolic acid) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (b):

(a) at least one endogenous or exogenous nucleic acid molecule encoding an enzyme having a serine aminase activity that catalyzes the conversion of L-serine to (S)-2,3-diaminopropanoate;

(b) at least one endogenous or exogenous nucleic acid molecule encoding an enzyme having an (S)-2,3-diaminopropanoate decarboxylase activity that catalyzes the conversion of (S)-2,3-diaminopropanoate from (a) to EDA;

wherein MEG and EDA are co-produced.

[DD] In one embodiment, the application relates to a recombinant microorganism capable of co-producing monoethylene glycol (MEG) (or glycolic acid) and ethylenediamine (EDA), from one or more pentose and/or hexose sugars and a nitrogen source, wherein the recombinant microorganism from embodiment [A], from embodiment [B], or from embodiment [C] (and optionally comprising embodiment [D]), and having additionally embodiment [E] for production of MEG in a C2 pathway, further expresses one or more of the following from (a) to (b):

(a) at least one endogenous or exogenous nucleic acid molecule encoding an enzyme having an (S)-2,3-diaminopropanoate ammonia lyase activity that catalyzes the conversion of pyruvate and ammonium to (S)-2,3-diaminopropanoate;

(b) at least one endogenous or exogenous nucleic acid molecule encoding an enzyme having (S)-2,3-diaminopropanoate decarboxylase activity that catalyzes the conversion of (S)-2,3-diaminopropanoate from (a) to EDA;

wherein G3P is converted to pyruvate via endogenous glycolysis in the recombinant microorganism, and wherein MEG and EDA are co-produced.

In some embodiments, an enzyme having 2,3-diaminopropionate ammonia-lyase activity is used to convert pyruvate and ammonium to (S)-2,3-diaminopropanoate. In some embodiments, an enzyme having 2,3-diaminopropionate ammonia-lyase activity is encoded by an amino acid sequence having at least 70% sequence identity, having at least 80% sequence identity, or having at least 90% sequence identity to *E. coli* 2,3-diaminopropionate ammonia-lyase ygeX. In other embodiments, the enzyme having 2,3-diaminopropionate ammonia-lyase activity is *E. coli* ygeX. In some embodiments, the one or more nucleic acid molecule encoding an enzyme having 2,3-diaminopropionate ammonia-lyase activity comprises an amino acid sequence set forth in UniProt ID P66899. In further embodiments, the one or more nucleic acid molecule encoding an enzyme having 2,3-diaminopropionate ammonia-lyase activity is encoded by a nucleic acid sequence set forth in Gene ID 947012.

In one embodiment of any aspect disclosed above, the enzyme having glycolaldehyde reductase activity is encoded by one or more nucleic acid molecules obtained from a microorganism selected from *E. coli* and *S. cerevisiae*. In another embodiment, the one or more nucleic acid molecules is selected from gldA, GRE2, GRE3, yqhD, ydjG, fucO, yafB (dkgB), and/or yqhE (dkgA), or homolog thereof. In another embodiment, the one or more nucleic acid molecules is yqhD. In some embodiments, the yqhD comprises a G149E mutation. In a further embodiment, the enzyme having glycolaldehyde reductase activity comprises an amino acid sequence selected from the group consisting of SEQ ID NOs: 13, 15, 17, 20, 23, 25, 28, 30 and 32. In yet a further embodiment, the enzyme having glycolaldehyde reductase activity is encoded by a nucleic acid sequence selected from the group consisting of SEQ ID NOs: 12, 14, 16, 18, 19, 21, 22, 24, 26, 27, 29 and 31.

In one embodiment of any aspect disclosed above, the enzyme having thiolase or acetyl coenzyme A acetyltransferase activity is encoded by one or more nucleic acid molecules obtained from a microorganism selected from the group consisting of *Clostridium* sp., *Bacillus* sp., *E. coli*, *Saccharomyces* sp. and *Marinobacter* sp. In some embodiments, the enzyme having thiolase or acetyl coenzyme A acetyltransferase activity is encoded by one or more nucleic acid molecules obtained from a microorganism selected from the group consisting of *Clostridium acetobutylicum*, *Clostridium thermosaccharolyticum*, *Bacillus cereus*, *E. coli*, *Saccharomyces cerevisiae* and *Marinobacter hydrocarbonoclasticus*. In some embodiments, the one or more nucleic acid molecules is thlA, atoB and/or ERG10, or homolog thereof. In a further embodiment, the enzyme having thiolase or acetyl coenzyme A acetyltransferase activity comprises an amino acid sequence selected from the group consisting of SEQ ID NOs: 35, 37 and 40. In yet a further embodiment, the enzyme having thiolase or acetyl coenzyme A acetyltransferase activity is encoded by a nucleic acid sequence selected from the group consisting of SEQ ID NOs: 33, 34, 36, 38 and 39.

In one embodiment of any aspect disclosed above, the enzyme having acetyl-CoA:acetoacetate-CoA transferase or acetate:acetoacetyl-CoA hydrolase activity is encoded by one or more nucleic acid molecules obtained from a microorganism selected from *Clostridium* sp. and *E. coli*. In another embodiment, the enzyme having acetyl-CoA:acetoacetate-CoA transferase or acetate:acetoacetyl-CoA hydrolase activity is encoded by one or more nucleic acid molecules obtained from *E. coli*. In some embodiments, the one or more nucleic acid molecules encoding the enzyme having acetyl-CoA:acetoacetate-CoA transferase activity is atoA and/or atoD, or homolog thereof. In another embodiment, the enzyme having acetyl-CoA:acetoacetate-CoA transferase or acetate:acetoacetyl-CoA hydrolase activity is encoded by one or more nucleic acid molecules obtained from *Clostridium acetobutylicum*. In some embodiments, the one or more nucleic acid molecules encoding the enzyme having acetate:acetoacetyl-CoA hydrolase activity is ctfA and/or ctfB, or homolog thereof. In a further embodiment, the enzyme having acetyl-CoA:acetoacetate-CoA transferase or acetate:acetoacetyl-CoA hydrolase activity comprises an amino acid sequence selected from the group consisting of SEQ ID NOs: 43, 46, 97, 99, 101 and 103. In yet a further embodiment, the enzyme having acetyl-CoA:acetoacetate-CoA transferase or acetate:acetoacetyl-CoA hydrolase activity is encoded by a nucleic acid sequence selected from the group consisting of SEQ ID NOs: 41, 42, 44, 45, 96, 98, 100 and 102.

In one embodiment of any aspect disclosed above, the enzyme having acetoacetate decarboxylase activity is encoded by one or more nucleic acid molecules obtained from a microorganism selected from the group consisting of *Clostridium* sp., *Bacillus* sp., *Chromobacterium* sp. and *Pseudomonas* sp. In another embodiment, the enzyme having acetoacetate decarboxylase activity is encoded by one or more nucleic acid molecules obtained from a microorganism selected from the group consisting of *Clostridium acetobutylicum, Clostridium beijerinckii, Clostridium cellulolyticum, Bacillus polymyxa, Chromobacterium violaceum* and *Pseudomonas putida*. In some embodiments, the one or more nucleic acid molecules encoding the enzyme having acetoacetate decarboxylase activity is adc, or homolog thereof. In a further embodiment, the enzyme having acetoacetate decarboxylase activity comprises an amino acid sequence selected from the group consisting of SEQ ID NOs: 49 and 52. In yet another embodiment, the enzyme having acetoacetate decarboxylase activity is encoded by a nucleic acid sequence selected from the group consisting of SEQ ID NOs: 47, 48, 50 and 51.

[EE] In another embodiment, the recombinant microorganism selected from embodiment [D] or embodiment [E], optionally further comprises one or more modifications selected from the group consisting of:
  (i) a deletion, insertion, or loss of function mutation in a gene encoding a glycolaldehyde reductase that catalyzes the conversion of glycolaldehyde to monoethyleneglycol (MEG);
  (ii) a deletion, insertion, or loss of function mutation in a gene encoding a glycolaldehyde dehydrogenase that catalyzes the conversion of glycolaldehyde to glycolic acid; and
  (iii) a deletion, insertion, or loss of function mutation in a gene encoding a lactate dehydrogenase that catalyzes the conversion of pyruvate to lactate.

In some embodiments, a recombinant microorganism producing glycolic acid comprises a deletion, insertion, or loss of function mutation in a gene encoding an enzyme having glycolaldehyde reductase activity to prevent the conversion of glycolaldehyde to monoethyleneglycol (MEG) and instead shunt the reaction toward conversion of glycolaldehyde to glycolic acid (GA). In some embodiments, the enzyme having glycolaldehyde reductase activity is from *Escherichia coli*. In some embodiments, the enzyme having glycolaldehyde reductase activity is encoded by the fucO gene, or homolog thereof.

In some embodiments, a recombinant microorganism producing MEG (or glycolic acid) or, MEG and one or more co-products, comprises a deletion, insertion, or loss of function mutation in a gene encoding a glycolaldehyde dehydrogenase to prevent the production of glycolic acid from glycolaldehyde and instead shunt the reaction toward conversion of glycolaldehyde to MEG. In some embodiments, the glycolaldehyde dehydrogenase is from *Escherichia coli*. In some embodiments, the glycolaldehyde dehydrogenase is encoded by the aldA gene, or homolog thereof. In some embodiments, the deletion, insertion, or loss of function mutation in a gene encoding a glycolaldehyde dehydrogenase is partial, wherein some glycolaldehyde dehydrogenase function is still present and an amount of glycolic acid is still produced.

In some embodiments, a recombinant microorganism producing MEG (or glycolic acid) or, optionally, MEG (or glycolic acid) and one or more co-products, comprises a deletion, insertion, or loss of function mutation in a gene encoding a lactate dehydrogenase to prevent the production of lactate from pyruvate and instead shunt the reaction toward production of one or more co-products. In some embodiments, the lactate dehydrogenase is from *Escherichia coli*. In some embodiments, the lactate dehydrogenase is encoded by the ldhA gene, or homolog thereof.

Non-limiting combinations of any of the recombinant microorganism and methods embodiments described herein are included as part of this disclosure.

Recombinant Microorganism

The disclosure provides microorganisms that can be engineered to express various endogenous or exogenous enzymes.

In various embodiments described herein, the recombinant microorganism is a eukaryotic microorganism. In some embodiments, the eukaryotic microorganism is a yeast. In exemplary embodiments, the yeast is a member of a genus selected from the group consisting of *Yarrowia, Candida, Saccharomyces, Pichia, Hansenula, Kluyveromyces, Issatchenkia, Zygosaccharomyces, Debaryomyces, Schizosaccharomyces, Pachysolen, Cryptococcus, Trichosporon, Rhodotorula*, and *Myxozyma*.

In some embodiments, the recombinant microorganism is a prokaryotic microorganism. In exemplary embodiments, the prokaryotic microorganism is a member of a genus selected from the group consisting of *Escherichia, Clostridium, Zymomonas, Salmonella, Rhodococcus, Pseudomonas, Bacillus, Lactobacillus, Enterococcus, Alcaligenes, Klebsiella, Paenibacillus, Arthrobacter, Corynebacterium*, and *Brevibacterium*.

In some embodiments, the recombinant microorganism is used to produce monoethylene glycol (MEG) or glycolic acid (GA), or MEG and one or more co-product, disclosed herein.

Accordingly, in another aspect, the present inventions provide a method of producing MEG or GA, or MEG and one or more co-product, using a recombinant microorganism described herein. In one embodiment, the method comprises cultivating the recombinant microorganism in a culture medium containing a feedstock providing a carbon source until MEG or GA, or MEG and one or more co-product, is produced. In a further embodiment, the MEG or GA, or MEG and one or more co-product, is recovered. Recovery can be by methods known in the art, such as distillation, membrane-based separation gas stripping, solvent extraction, and expanded bed adsorption.

In some embodiments, the feedstock comprises a carbon source. In various embodiments described herein, the carbon source may be selected from sugars, glycerol, alcohols, organic acids, alkanes, fatty acids, lignocellulose, proteins, carbon dioxide, and carbon monoxide. In an exemplary embodiment, the carbon source is a sugar. In some embodiments, the sugar comprises one or more pentose and/or hexose sugar. In other embodiments, the one or more pentose and/or hexose sugars are comprised of monomers, oligomers, or a combination thereof. In a further exemplary embodiment, the sugar is glucose or oligomers of glucose thereof. In other embodiments, the oligomers of glucose are selected from fructose, sucrose, starch, cellobiose, maltose, lactose and cellulose. In yet further embodiments, the sugars comprise D-xylose, D-galactose, D-mannose, D-arabinose, L-arabinose, D-fructose, or a combination thereof.

Methods of Producing a Recombinant Microorganism that Produces or Accumulates MEG (or Glycolic Acid), or MEG and One or More Co-Product In another aspect, the application provides for a method of producing one or more products derived from glyceraldehyde-3-phosphate (G3P) and glycolaldehyde using a recombinant microorganism of any of the above embodiments, wherein the method comprises cultivating the recombinant microorganism in a culture medium containing one or more pentose and/or hexose sugars providing a carbon source until the one or more products derived from glyceraldehyde-3-phosphate (G3P) and glycolaldehyde are produced. In some embodiments, the recombinant microorganism co-produces monoethylene glycol (MEG) and one or more co-products. In further embodiments, the one or more co-products are selected from acetone, isopropanol, propene, L-serine, glycine, monoethanolamine (MEA), ethylenediamine (EDA), or a combination thereof. In yet further embodiments, the one or more product is selected from monoethylene glycol (MEG) and glycolic acid (GA).

In yet another aspect, the application provides for a method of producing a recombinant microorganism that produces or accumulates one or more products derived from glyceraldehyde-3-phosphate (G3P) and glycolaldehyde from one or more pentose and/or hexose sugars via a pentose-phosphate intermediate, wherein the pentose-phosphate intermediate is D-ribose-5-phosphate, D-ribulose-5-phosphate or D-xylulose-5-phosphate, comprising: introducing into or expressing in the recombinant microorganism one or more enzyme for the conversion of the one or more pentose and/or hexose sugars to the pentose-phosphate intermediate; introducing into or expressing in the recombinant microorganism one or more enzyme for the conversion of the D-ribose-5-phosphate intermediate to G3P and glycolaldehyde; introducing into or expressing in the recombinant microorganism one or more enzyme for the production of the one or more products from glycolaldehyde in a C2 pathway; and introducing into or expressing in the recombinant microorganism one or more enzymes for the production of the one or more products from G3P in one or more C3 pathways; and culturing the recombinant microorganism in a culture medium containing the one or more pentose and/or hexose sugars to produce or accumulate the one or more products. In some embodiments, the recombinant microorganism co-produces monoethylene glycol (MEG) and one or more co-products. In further embodiments, the one or more co-products are selected from acetone, isopropanol, propene, L-serine, glycine, monoethanolamine (MEA), ethylenediamine (EDA), or a combination thereof. In yet further embodiments, the one or more product is selected from monoethylene glycol (MEG) and glycolic acid (GA). In some embodiments, the glycolaldehyde is oxidized to GA by a glycolaldehyde dehydrogenase.

In one embodiment, the application relates to a method of producing a recombinant microorganism that produces or accumulates one or more products derived from glyceraldehyde-3-phosphate (G3P) and glycolaldehyde from one or more pentose and/or hexose sugars via a pentose-phosphate intermediate, comprising: introducing into or expressing in the recombinant microorganism at least one enzyme having an activity that converts one or more pentose and/or hexose sugars in a lossless conversion pentose-phosphate intermediate and comprising at least one enzyme having a pentose-phosphate aldolase activity, wherein the enzyme has D-ribose-5-phosphate aldolase activity, D-ribulose-5-phosphate aldolase activity, or D-xylulose-5-phosphate aldolase activity, that converts the D-ribose-5-phosphate intermediate to glycolaldehyde and D-glyceraldehyde-3-phosphage (G3P).

In some embodiments, the method comprises introducing into or expressing in the recombinant microorganism at least one enzyme having transketolase activity and expression of at least one enzyme having D-ribose-5-phosphate aldolase activity. In some embodiments, the enzyme having transketolase activity is encoded by an amino acid sequence having at least 70% sequence identity, at least 80% sequence identity, or at least 90% sequence identity to tktA from *E. coli*. In other embodiments, the enzyme having transketolase activity is tktA from *E. coli*. In some embodiments, the enzyme having transketolase activity is encoded by an amino acid sequence having at least 70% sequence identity at least 80% sequence identity, or at least 90% sequence identity to tktB from *E. coli*. In other embodiments, the enzyme having transketolase activity is tktB from *E. coli*. In another embodiment, the one or more nucleic acid molecules encoding the enzyme having transketolase activity comprises an amino acid sequence selected from the group consisting of SEQ ID NOs: 148 and 150. In some embodiments, the one or more nucleic acid molecules encoding the enzyme having transketolase activity is tktA, or homolog thereof. In some embodiments, the one or more nucleic acid molecules encoding the enzyme having transketolase activity is tktB, or homolog thereof. In a further embodiment, the one or more nucleic acid molecule encoding the enzyme having transketolase activity is encoded by a nucleic acid sequence selected from the group consisting of SEQ ID NOs: 147 and 149. In some embodiments, the enzyme having D-ribose-5-phosphate aldolase activity is encoded by an amino acid sequence having at least 70% sequence identity, at least 80% sequence identity, or at least 90% sequence identity to deoC from *E. coli*. In other embodiments, the enzyme having D-ribose-5-phosphate aldolase activity is deoC from *E. coli*.

In some embodiments, the method comprises introducing into or expressing in the recombinant microorganism at least one enzyme having transaldolase activity. In some embodiments, the enzyme having transaldolase activity is encoded by an amino acid sequence having at least 70% sequence identity, at least 80% sequence identity, or at least 90% sequence identity to talA or talB from *E. coli*. In some embodiments, the enzyme having transaldolase activity is talA from *E. coli*. In other embodiments, the enzyme having transaldolase activity is talB from *E. coli*. In another embodiment, the one or more nucleic acid molecules encoding the enzyme having transaldolase activity comprises an amino acid sequence selected from the group consisting of SEQ ID NOs: 152 and 154. In a further embodiment, the one or more nucleic acid molecule encoding the enzyme having transaldolase activity is encoded by a nucleic acid sequence selected from the group consisting of SEQ ID NOs: 151 and 153.

In some embodiments, the method comprises introducing into or expressing in the recombinant microorganism at least one enzyme having ribulose-5-phosphate 3-epimerase activity. In some embodiments, the enzyme having ribulose-5-phosphate 3-epimerase activity is encoded by an amino acid sequence having at least 70% sequence identity, at least 80% sequence identity, or at least 90% sequence identity to rpe from *E. coli*. In other embodiments, the enzyme having ribulose-5-phosphate 3-epimerase activity is rpe from *E. coli*. In another embodiment, the one or more nucleic acid molecules encoding the enzyme having ribulose-5-phosphate 3-epimerase activity comprise an amino acid sequence set forth in SEQ ID NO: 158. In a further embodiment, the one or more nucleic acid molecule encoding the enzyme having ribulose-5-phosphate 3-epimerase activity is encoded by a nucleic acid sequence set forth in SEQ ID NO: 157.

In some embodiments, the method comprises introducing into or expressing in the recombinant microorganism at least one enzyme having ribose-5-phosphate isomerase activity. In some embodiments, the enzyme having ribose-5-phosphate isomerase activity is encoded by an amino acid sequence having at least 70% sequence identity, at least 80% sequence identity, or at least 90% sequence identity to rpiA from *E. coli*. In other embodiments, the enzyme having ribose-5-phosphate isomerase activity is rpiA from *E. coli*. In other embodiments, the enzyme having ribose-5-phosphate isomerase activity is encoded by an amino acid sequence having at least 70% sequence identity, at least 80% sequence identity, or at least 90% sequence identity to rpiB from *E. coli*. In other embodiments, the enzyme having ribose-5-phosphate isomerase activity is rpiB from *E. coli*. In another embodiment, the one or more nucleic acid molecules encoding enzyme having ribose-5-phosphate isomerase activity comprise an amino acid sequence set forth in SEQ ID NO: 156. In a further embodiment, the one or more nucleic acid molecule encoding the enzyme having ribose-5-phosphate isomerase activity is encoded by a nucleic acid sequence set forth in SEQ ID NO: 155.

In some embodiments, the method comprises introducing into or expressing in the recombinant microorganism at least one enzyme having an activity selected from a transketolase activity, a transaldolase activity, a ribulose-5-phosphate 3-epimerase activity, a ribose-5-phosphate isomerase activity and a D-ribose-5-phosphate aldolase activity. In other embodiments, the method further comprises introducing into the recombinant microorganism one or more modifications to diminish or delete activity in one or more endogenous enzymes selected from glyceraldehyde 3-phosphate dehydrogenase, phosphoglycerate kinase and phosphoglycerate kinase and phosphoglycerate mutase. In some embodiments, the endogenous glyceraldehyde 3-phosphate dehydrogenase enzyme is gapA, the phosphoglycerate kinase is pgk and the phosphoglycerate mutase is gpmA or gpmM.

In some embodiments, the method comprises introducing into or expressing in the recombinant microorganism at least one enzyme having fructose-6-phosphate phosphoketolase activity. In some embodiments, an enzyme having fructose-6-phosphate phosphoketolase activity is encoded by an amino acid sequence having at least 70% sequence identity, at least 80% sequence identity, or at least 90% sequence identity to an enzyme having fructose-6-phosphate phosphoketolase activity selected from the group consisting of *Bifidobacterium dentium* BDP_1006, *Bifidobacterium lactis* xfp, *Lactobacillus paraplantarum* xpkA and *Bifidobacterium breve* xfp. In a preferred embodiment, an enzyme having fructose-6-phosphate phosphoketolase activity is selected from the group consisting of *Bifidobacterium dentium* BDP_1006, *Bifidobacterium lactis* xfp, *Lactobacillus paraplantarum* xpkA and *Bifidobacterium breve* xfp. In another embodiment, the one or more nucleic acid molecules encoding the enzyme having fructose-6-phosphate phosphoketolase activity comprise an amino acid sequence selected from the group consisting of SEQ ID NOs: 212, 214, 216 and 218. In a further embodiment, the one or more nucleic acid molecule encoding the enzyme having fructose-6-phosphate phosphoketolase activity is encoded by a nucleic acid sequence selected from the group consisting of SEQ ID NOs: 211, 213, 215 and 217.

In some embodiments, the method comprises introducing into or expressing in the recombinant microorganism at least one enzyme having phosphate acetyltransferase activity. In some embodiments, an enzyme having phosphate acetyltransferase activity is encoded by an amino acid sequence having at least 70% sequence identity, at least 80% sequence identity, or at least 90% sequence identity to an enzyme having phosphate acetyltransferase activity selected from *E. coli* pta and *Clostridium acetobutylicum* pta. In a preferred embodiment, an enzyme having phosphate acetyltransferase activity is selected from *E. coli* pta and *Clostridium acetobutylicum* pta. In another embodiment, the one or more nucleic acid molecules encoding the enzyme having phosphate acetyltransferase activity comprise an amino acid sequence selected from SEQ ID NOs: 220 and 222. In a further embodiment, the one or more nucleic acid molecule encoding the enzyme having phosphate acetyltransferase activity is encoded by a nucleic acid sequence selected from SEQ ID NOs: 219 and 221.

In some embodiments, the method comprises introducing into or expressing in the recombinant microorganism at least one enzyme having an activity selected from a fructose-6-phosphate phosphoketolase activity, a phosphate acetyltransferase activity, a transketolase activity, a transaldolase activity, a ribulose-5-phosphate 3-epimerase activity, a ribose-5-phosphate isomerase activity and a D-ribose-5-phosphate aldolase activity. In other embodiments, the method further comprises introducing into the recombinant microorganism one or more modifications to diminish or delete activity in an endogenous 6-phosphofructokinase enzyme. In some embodiments, the endogenous 6-phosphofructokinase enzyme is pfkA and/or pfkB.

In some embodiments, the one or more pentose and/or hexose sugars comprise D-xylose and the method further comprises introducing into or expressing in the recombinant microorganism at least one enzyme having xylose isomerase activity and expression of at least one enzyme having xylulose 5-kinase activity. In some embodiments, the at least one enzyme having xylose isomerase activity is encoded by an amino acid sequence having at least 70% sequence identity, at least 80% sequence identity, or at least 90% sequence identity to xylA from *E. coli* or *Pyromyces* sp. In a preferred embodiment, an enzyme having xylose isomerase activity is selected from *E. coli* xylA and *Pyromyces* sp xylA. In yet another embodiment, the one or more nucleic acid molecules encoding the xylose isomerase comprises an amino acid sequence selected from SEQ ID NOs: 95 and 144. In a further embodiment, the one or more nucleic acid molecules encoding the xylose isomerase is encoded by a nucleic acid sequence selected from the group consisting of SEQ ID NOs: 93, 94 and 143. In some embodiments, the at least one enzyme having xylulose 5-kinase activity is encoded by an amino acid sequence having at least 70% sequence identity, at least 80% sequence identity, or at least 90% sequence identity to xylB from *E. coli*. In a preferred embodiment, an enzyme having xylulose 5-kinase activity is *E. coli* xylB. In another embodiment, the one or more nucleic acid molecules encoding the D-xylulose 5-kinase comprises an amino acid sequence set forth in SEQ ID NO: 146. In a further embodiment, the one or more nucleic acid molecules encoding the D-xylulose 5-kinase is encoded by a nucleic acid sequence set forth in SEQ ID NO: 145.

In some embodiments, the one or more pentose and/or hexose sugars comprise D-fructose and the method further comprises introducing into or expressing in the recombinant microorganism at least one enzyme having fructose 1,6- bisphosphatase activity. In one embodiment, the at least one enzyme having fructose 1,6-bisphosphatase activity is encoded by an amino acid sequence having at least 70% sequence identity, at least 80% sequence identity, or at least 90% sequence identity to fbp from *E. coli*. In a preferred embodiment, an enzyme having fructose 1,6-bisphosphatase activity is *E. coli* fbp. In some embodiments, the enzyme having fructose 1,6-bisphosphatase activity converts D-fructose 1,6-bisphosphate to D-fructose 6-phosphate. In other embodiments, D-fructose is converted to fructose 1,6-bisphoshate by endogenous enzymes in the recombinant microorganism.

In some embodiments of any of the methods described above, the method further comprises introducing into the recombinant microorganism one or more modifications to diminish or delete activity in one or more endogenous enzymes selected from glucose 6-phosphate-1-dehydrogenase, 6-phosphogluconolactonase, and 6-phosphogluconate dehydrogenase. In further embodiments, the glucose 6-phosphate-1-dehydrogenase is zwf, the 6-phosphogluconolactonase is pgl, and the 6-phosphogluconate dehydrogenase is gnd.

In some embodiments, the one or more pentose and/or hexose sugars are capable of being converted to one or more intermediate in the non-oxidative pentose phosphate pathway of the recombinant microorganism. In other embodiments, the one or more pentose and/or hexose sugars are comprised of monomers, oligomers, or a combination thereof.

In some embodiments, the expression of at least one enzyme having transketolase activity and/or fructose-6-phosphate phosphoketolase activity and the expression of at least one enzyme having pentose-phosphate aldolase activity enables a lossless conversion of one or more pentose and/or hexose sugars to pentose-phosphate intermediates and the subsequent conversion of pentose-phosphate to G3P and glycolaldehyde.

In some embodiments, the methods allow for the production of MEG or glycolic acid (GA) through the conversion of glycolaldehyde in a C2 pathway and through the conversion of G3P in one or more C3 pathways. In some embodiments, MEG is produced by the reduction of glycolaldehyde by an enzyme having glycolaldehyde reductase activity in a C2 pathway. In other embodiments, GA is produced by the oxidation of glycolaldehyde by an enzyme having glycolaldehyde dehydrogenase activity in a C2 pathway.

In some embodiments, the at least one enzyme for the production of MEG or GA are selected from at least one enzyme having an activity selected from a 3-phosphoglycerate dehydrogenase activity, a phosphoserine aminotransferase activity, a serine transaminase activity, a 3-phosphohydroxypyruvate phosphatase activity, a phosphoserine phosphatase activity, a hydroxypyruvate decarboxylase activity, a 3-phosphohydroxypyruvate reductase activity, a glycolaldehyde reductase activity, a glycolaldehyde dehydrogenase activity, a serine oxidoreductase (deaminating) or serine-pyruvate aminotransferase activity, a serine decarboxylase activity, an ethanolamine aminotransferase or ethanolamine oxidoreductase (deaminating) activity, a glycerate decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, and a glyoxylate reductase activity.

In some embodiments, the methods allow for the production of MEG through the conversion of glycolaldehyde in a C2 pathway and for the production of one or more co-product through the conversion of G3P in one or more C3 pathways. In other embodiments, the one or more co-product is selected from acetone, isopropanol, propene, isobutene and one or more serine pathway compounds. In some preferred embodiments, the one or more serine pathway compounds is selected from serine, glycine, monoethanolamine (MEA) and ethylenediamine (EDA).

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, and an acetoacetate decarboxylase activity, and the one or more co-product comprises acetone.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, and a secondary alcohol dehydrogenase activity, and the one or more co-product comprises isopropanol.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a secondary alcohol dehydrogenase activity, and a dehydratase activity, and the one or more co-product comprises propene.

In some embodiments, the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a 3-hydroxyisovalerate (3HIV) synthase activity, a hydroxymethylglutaryl-CoA synthase activity, a methylglutaconyl-CoA hydratase activity, a methylcrotonyl-CoA carboxylase activity, a methylcrotonyl-CoA hydratase activity, a 3-hydroxyisovaleryl-CoA thioesterase activity, a 3HIV kinase activity, a 3HIV-3-phosphate decarboxylase activity, and a 3HIV decarboxylase activity, and the one or more co-product comprises isobutene.

In some embodiments, the at least one enzyme for the production of one or more co-product through the conversion of G3P in one or more C3 pathways are selected from at least one enzyme having an activity selected from a 3-phosphoglycerate dehydrogenase activity, a phosphoserine aminotransferase activity, a 3-phosphohydroxypyruvate phosphatase activity, a phosphoserine phosphatase activity, a serine oxidoreductase (deaminating) or serine-pyruvate aminotransferase activity, a hydroxypyruvate reductase activity, a 3-phosphoglycerate phosphatase activity, a 2-phosphoglycerate phosphatase activity, a glycerate 3-kinase activity, and a glycerate 2-kinase activity, and the one or more co-product comprises L-serine.

In some embodiments, the at least one enzyme for the production of one or more co-product through the conversion of G3P in one or more C3 pathways are selected from at least one enzyme having an activity selected from a serine hydroxymethyltransferase activity, a transferase activity, a formaldehyde dehydrogenase activity, a formate dehydrogenase activity, an activity associated with glycine cleavage system, a 3-phosphoglycerate dehydrogenase activity, a phosphoserine aminotransferase activity, a 3-phosphohydroxypyruvate phosphatase activity, a phosphoserine phosphatase activity, a serine transaminase activity, a hydroxypyruvate decarboxylase activity, a serine oxidoreductase (deaminating) activity, a serine decarboxylase activity, an ethanolamine aminotransferase or ethanolamine oxidoreductase (deaminating) activity, a hydroxypyruvate reductase activity, a 3-phosphoglycerate phosphatase activity, a 2-phosphoglycerate phosphatase activity, a glycerate 3-kinase activity, a glycerate 2-kinase activity, a glycolaldehyde dehydrogenase activity, a glycolate dehydrogenase activity, an alanine-glyoxylate aminotransferase activity, an alanine transaminase activity, an NAD(P)H dependent glutamate dehydrogenase activity, and the one or more co-product comprises glycine. In another embodiment, the activity associated with glycine cleavage system comprise an enzyme or protein selected from a glycine decarboxylase (P protein), an aminomethyltransferase (T protein), a dihydrolipoamide dehydrogenase (L protein), and an H protein.

In some embodiments, the at least one enzyme for the production of one or more co-product through the conversion of G3P in one or more C3 pathways are selected from at least one enzyme having an activity selected from a 3-phosphoglycerate dehydrogenase activity, a 3-phosphoserine aminotransferase activity, a 3-phosphohydroxypyruvate phosphatase activity, a phosphoserine phosphatase activity, a transaminase activity, a hydroxypyruvate decarboxylase activity, a serine oxidoreductase (deaminating) or serine-pyruvate aminotransferase activity, a serine decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, an acetaldehyde dehydrogenase activity, and an ethanolamine ammonia lyase activity, and the one or more co-product comprises monoethanolamine (MEA).

In some embodiments, the at least one enzyme for the production of one or more co-product through the conversion of G3P in one or more C3 pathways are selected from at least one enzyme having an activity selected from a serine dehydrogenase activity, a 2-aminomalonate semialdehyde decarboxylase activity, an aminoacetaldehyde transaminase activity, a 2-aminomalonate semialdehyde transaminase activity, a 2,3-diaminopropanoate decarboxylase activity, a serine decarboxylase activity, an ethanolamine dehydrogenase activity, a serine hydroxymethyltransferase activity, an aldehyde oxidase activity, an N-acetyl transferase or O-acetyl transferase activity, an N-acetylserine dehydrogenase activity, a transaminase activity, a deacetylase activity, a serine aminase activity, and a 2,3-diaminopropanoate ammonia lyase activity, and the one or more co-product comprises ethylenediamine (EDA).

In some embodiments of any of the methods described above, the method further comprises introducing into the recombinant microorganism one or more modifications to diminish or delete activity in a glycolaldehyde reductase, a glycolaldehyde dehydrogenase, a lactate dehydrogenase, or combination thereof.

In one embodiment, at least a portion of the excess NADH produced in the C3 pathway is used as a source of reducing equivalents in the C2 pathway. In another embodiment, at least a portion of the excess NADH produced in the C3 pathway is used to produce ATP.

In one embodiment, excess biomass formation is minimized and production of MEG or glycolic acid or MEG and one or more co-products is maximized.

Pentose and/or Hexose Sugars to Pentose-Phosphate Intermediate and Subsequent Conversion of Pentose-Phosphate Intermediate to Glycolaldehyde and D-Glyceraldehyde 3-Phosphate In the present disclosure, pentose and/or hexose sugars are converted into pentose-phosphate, an intermediate of the non-oxidative pentose phosphate pathway, wherein the pentose-phosphate intermediate is D-ribose-5-phosphate, D-ribulose-5-phosphate or D-xylulose-5-phosphate. The pentose-phosphate intermediate then serves as a substrate for a pentose-phosphate aldolase, wherein the aldolase has D-ribose-5-phosphate aldolase activity, D-ribulose-5-phosphate aldolase activity, or D-xylulose-5-phosphate aldolase activity to produce glycolaldehyde and D-glyceraldehyde 3-phosphate, compounds which can then be further converted to MEG or GA, or MEG and one or more co-products.

[mA] Therefore, in one embodiment, the application relates to a method of producing a recombinant microorganism capable of producing glycolaldehyde and D-glyceraldehyde 3-phosphate (G3P) via a pentose-phosphate intermediate from one or more pentose and/or hexose sugars, wherein the method comprises introducing into or expressing in the recombinant microorganism one or more of the following from (a) to (h):

(a) at least one endogenous or exogenous nucleic acid molecule encoding an enzyme having transketolase activity that catalyzes a reversible conversion of D-fructose-6-phosphate and D-glyceraldehyde-3-phosphate to D-erythrose-4-phosphate and D-xylulose-5-phosphate, respectively, and/or that catalyzes a reversible conversion of D-glyceraldehyde-3-phosphate from (b) and D-seduheptulose-7-phosphate from (b) to D-ribose-5-phosphate and D-xylulose-5-phosphate, respectively;

(b) at least one endogenous or exogenous nucleic acid molecule encoding an enzyme having transaldolase activity that catalyzes a reversible conversion of D-fructose-6-phosphate and D-erythrose-4-phosphate from (a) to D-glyceraldehyde-3-phosphate and D-seduheptulose-7-phosphate, respectively;

(c) at least one endogenous or exogenous nucleic acid molecule encoding an enzyme having ribulose-5-phosphate 3-epimerase activity that catalyzes an interconversion of D-xylulose-5-phosphate from (a) and/or (f) and D-ribulose-5-phosphate;

(d) at least one endogenous or exogenous nucleic acid molecule encoding an enzyme having ribose-5-phosphate isomerase activity that catalyzes an interconversion of D-ribulose-5-phosphate from (c) and D-ribose-5-phosphate;

(e) at least one endogenous or exogenous nucleic acid molecule encoding an enzyme having xylose isomerase activity that catalyzes the conversion of D-xylose to D-xylulose;

(f) at least one endogenous or exogenous nucleic acid molecule encoding an enzyme having xylulose 5-kinase activity that catalyzes the conversion of D-xylulose to D-xylulose-5-phosphate;

(g) at least one endogenous or exogenous nucleic acid molecule encoding an enzyme having fructose 1,6-bisphosphatase activity that catalyzes the conversion of D-fructose 1,6-bisphosphate to D-fructose 6-phosphate;

(h) at least one endogenous or exogenous nucleic acid molecule encoding an enzyme having D-ribose 5-phosphate aldolase activity that catalyzes the conversion of D-ribose- 5-phosphate from (a) and/or (d) to glycolaldehyde and D-glyceraldehyde-3-phosphate;

wherein the method optionally further comprises introducing a deletion, insertion, or loss of function mutation in a gene encoding a glyceraldehyde 3-phosphate dehydrogenase, a phosphoglycerate kinase and/or a phosphoglycerate mutase;

wherein the one or more pentose and/or hexose sugars are capable of being converted to one or more intermediate in the non-oxidative pentose phosphate pathway of the recombinant microorganism, and wherein glycolaldehyde and D-glyceraldehyde 3-phosphate (G3P) are produced.

[mB] In another embodiment, the application relates to a method of producing a recombinant microorganism capable of producing glycolaldehyde and D-glyceraldehyde 3-phosphate (G3P) via a pentose-phosphate intermediate from one or more pentose and/or hexose sugars, wherein the method comprises introducing into or expressing in the recombinant microorganism one or more of the following from (a) to (j):

(a) at least one endogenous or exogenous nucleic acid molecule encoding an enzyme having fructose-6-phosphate phosphoketolase activity that catalyzes a reversible conversion of D-fructose-6-phosphate to D-erythrose-4-phosphate and acetyl-phosphate;

(b) at least one endogenous or exogenous nucleic acid molecule encoding an enzyme having phosphate acetyltransferase activity that catalyzes a reversible conversion of acetyl-phosphate from (a) to acetyl-CoA;

(c) at least one endogenous or exogenous nucleic acid molecule encoding an enzyme having transaldolase activity that catalyzes a reversible conversion of D-fructose-6-phosphate and D-erythrose-4-phosphate from (a) to D-glyceraldehyde-3-phosphate and D-seduheptulose-7-phosphate, respectively;

(d) at least one endogenous or exogenous nucleic acid molecule encoding an enzyme having transketolase activity that catalyzes a reversible conversion of D-glyceraldehyde-3-phosphate from (c) and D-seduheptulose-7-phosphate from (c) to D-ribose-5-phosphate and D-xylulose-5-phosphate, respectively;

(e) at least one endogenous or exogenous nucleic acid molecule encoding an enzyme having ribulose-5-phosphate 3-epimerase activity that catalyzes an interconversion of D-xylulose-5-phosphate from (d) and/or (h) and D-ribulose-5-phosphate;

(f) at least one endogenous or exogenous nucleic acid molecule encoding an enzyme having ribose-5-phosphate isomerase activity that catalyzes an interconversion of D-ribulose-5-phosphate from (e) and D-ribose-5-phosphate;

(g) at least one endogenous or exogenous nucleic acid molecule encoding an enzyme having xylose isomerase activity that catalyzes the conversion of D-xylose to D-xylulose;

(h) at least one endogenous or exogenous nucleic acid molecule encoding an enzyme having xylulose 5-kinase activity that catalyzes the conversion of D-xylulose to D-xylulose-5-phosphate;

(i) at least one endogenous or exogenous nucleic acid molecule encoding an enzyme having fructose 1,6-bisphosphatase activity that catalyzes the conversion of D-fructose 1,6-bisphosphate to D-fructose 6-phosphate;

(j) at least one endogenous or exogenous nucleic acid molecule encoding an enzyme having D-ribose 5-phosphate aldolase activity that catalyzes the conversion of D-ribose-5-phosphate from (d) and/or (f) to glycolaldehyde and D-glyceraldehyde-3-phosphate;

wherein the method optionally further comprises introducing a deletion, insertion, or loss of function mutation in a gene encoding a 6-phosphofructokinase;

wherein the one or more pentose and/or hexose sugars are capable of being converted to one or more intermediate in the non-oxidative pentose phosphate pathway of the recombinant microorganism, wherein the acetyl-CoA produced in step (b) can be used to produce one or more co-products selected from glycolic acid, acetone, isopropanol, propene, isobutene, and one or more serine pathway compounds;

and wherein glycolaldehyde and D-glyceraldehyde 3-phosphate (G3P) are produced.

In some embodiments, the oxidative branch of the pentose phosphate pathway is deleted or inactivated to optimize flux of sugars towards the non-oxidative entry into the pentose phosphate pathway.

[mC] Therefore, in one embodiment, the method of embodiment [mA] or embodiment [mB] optionally further comprises introducing one or more modifications selected from the group consisting of:

(i) a deletion, insertion, or loss of function mutation in a gene encoding a glucose 6-phosphate-1-dehydrogenase that catalyzes the conversion of glucose-6-phosphate to 6-phospho-D-glucono-1,5-lactone;

(ii) a deletion, insertion, or loss of function mutation in a gene encoding a 6-phosphogluconolactonase that catalyzes the conversion of 6-phospho-D-glucono-1,5-lactone to gluconate-6-phosphate; and (iii) a deletion, insertion, or loss of function mutation in a gene encoding a 6-phosphogluconate dehydrogenase that catalyzes the conversion of gluconate-6-phosphate to D-ribulose-5-phosphate.

MEG or Glycolic Acid, or MEG and Co-Product Production Pathways

In some embodiments, the glycolaldehyde and glyceraldehyde-3-phosphate intermediates produced from embodiment [mA] or from embodiment [mB] (and optionally comprising embodiment [mC]) are used in known MEG (or glycolic acid) C2 production pathways, which are coupled to C3 pathways, as described below, to co-produce additional MEG (or glycolic acid) and/or one or more co-products.

In some embodiments, MEG is produced via a C2 pathway that uses an enzyme having glycolaldehyde reductase activity to convert glycolaldehyde to MEG. In another embodiment, glycolic acid (GA) is produced via a C2 pathway that uses an enzyme having glycolaldehyde dehydrogenase activity to oxidize glycolaldehyde to GA.

[mD] In one embodiment, the application relates to a method of producing a recombinant microorganism capable of producing monoethylene glycol (MEG) from one or more pentose and/or hexose sugars, wherein the method of embodiment [mA] or embodiment [mB] (and optionally comprising embodiment [mC]), further comprises introducing into or expressing in the recombinant microorganism: at least one endogenous or exogenous nucleic acid molecule encoding an enzyme having glycolaldehyde reductase activity that catalyzes the conversion of glycolaldehyde to MEG, wherein the recombinant microorganism optionally further comprises a deletion, insertion, or loss of function mutation in a gene encoding a glycolaldehyde dehydrogenase, and wherein MEG is produced.

[mE] In one embodiment, the application relates to a method of producing a recombinant microorganism capable of producing glycolic acid (GA) from one or more pentose and/or hexose sugars, wherein the method of embodiment [mA] or embodiment [mB] (and optionally comprising embodiment [mC]), further comprises introducing into or expressing in the recombinant microorganism: at least one endogenous or exogenous nucleic acid molecule encoding an enzyme having glycolaldehyde dehydrogenase activity that catalyzes the conversion of glycolaldehyde to GA, wherein the recombinant microorganism optionally further comprises a deletion, insertion, or loss of function mutation in a gene encoding a glycolaldehyde reductase, and wherein GA is produced.

Production of MEG (or Glycolic Acid) Via a C2 Pathway and MEG (or Glycolic Acid) Via a C3 Pathway In one aspect, MEG (or glycolic acid) is produced from one or more pentose and/or hexose sugars by the lossless transformation of the one or more pentose and/or hexose sugars to pentose-phosphate intermediate, followed by a conversion of the pentose-phosphate intermediate to glycolaldehyde and G3P intermediates, followed by a conversion of the glycolaldehyde intermediate to MEG (or glycolic acid) via a C2 pathway, and a conversion of G3P to MEG (or glycolic acid) via a C3 pathway. Wherein the pentose-phosphate intermediate is D-ribose-5-phosphate, D-ribulose-5-phosphate or D-xylulose-5-phosphate.

In some embodiments, the application relates to a method of producing a recombinant microorganism capable of producing MEG (or glycolic acid) from one or more pentose and/or hexose sugars, wherein the method of embodiment [mA] or embodiment [mB] (and optionally comprising embodiment [mC]), and having additionally embodiment [mD] or embodiment [mE] for production of MEG (or glycolic acid) in a C2 pathway, further comprises one or more C3 biosynthesis pathway for the production of MEG (or glycolic acid).

[mK] In one embodiment, the application relates to a method of producing a recombinant microorganism capable of producing monoethylene glycol (MEG) (or glycolic acid) from one or more pentose and/or hexose sugars and a nitrogen source, wherein the method of embodiment [mA] or embodiment [mB] (and optionally comprising embodiment [mC]), and having additionally embodiment [mD] or embodiment [mE] for production of MEG (or glycolic acid) in a C2 pathway, further comprises introducing into or expressing in the recombinant microorganism one or more of the following from (a) to (h):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having phosphoserine aminotransferase activity that catalyzes the conversion of 3-phosphohydroxypyruvate from (a) to phospho-L-serine;

(c) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(d) at least one endogenous or exogenous nucleic acid molecule encoding an enzyme having phosphoserine phosphatase activity that catalyzes the conversion of phospho-L-serine from (b) to L-serine;

(e) at least one endogenous or exogenous nucleic acid molecule encoding an enzyme having L-serine transaminase or serine oxidase activity that catalyzes the conversion of L-serine from (d) to hydroxypyruvate;

(f) at least one endogenous or exogenous nucleic acid molecule encoding an enzyme having hydroxypyruvate decarboxylase activity that catalyzes the conversion of hydroxypyruvate from (c) or (e) to glycolaldehyde;

(g) at least one endogenous or exogenous nucleic acid molecule encoding an enzyme having glycolaldehyde reductase activity that catalyzes the conversion of glycolaldehyde from (f) to MEG;

(h) at least one endogenous or exogenous nucleic acid molecule encoding an enzyme having glycolaldehyde dehydrogenase activity that catalyzes the conversion of glycolaldehyde from (f) to glycolic acid;

wherein the produced intermediate G3P from embodiment [mA] or from embodiment [mB] is converted to 3-phosphoglycerate through endogenous glycolysis in the recombinant microorganism, and wherein MEG (or glycolic acid) is produced.

[mL] In one embodiment, the application relates to a method of producing a recombinant microorganism capable of producing monoethylene glycol (MEG) (or glycolic acid) from one or more pentose and/or hexose sugars and a nitrogen source, wherein the method of embodiment [mA] or embodiment [mB] (and optionally comprising embodiment [mC]), and having additionally embodiment [mD] or embodiment [mE] for production of MEG (or glycolic acid) in a C2 pathway, further comprises introducing into or expressing in the recombinant microorganism one or more of the following from (a) to (j):

(a) at least one endogenous or exogenous nucleic acid molecule encoding an enzyme having 2-phosphoglycerate phosphatase activity and/or an enzyme having glycerate-2-kinase activity that catalyzes the conversion of 2-phosphoglycerate to glycerate;

(b) at least one endogenous or exogenous nucleic acid molecule encoding an enzyme having 3-phosphoglycerate phosphatase activity or an enzyme having glycerate-3-kinase activity that catalyzes the conversion of 3-phosphoglycerate to glycerate;

(c) at least one endogenous or exogenous nucleic acid molecule encoding an enzyme having hydroxypyruvate reductase activity that catalyzes the conversion of glycerate from (a) and/or (b) to hydroxypyruvate;

(d) at least one endogenous or exogenous nucleic acid molecule encoding an enzyme having serine aminotransferase activity or an enzyme having serine oxidoreductase (deaminating) activity that catalyzes the conversion of L-serine to hydroxypyruvate;

(e) at least one endogenous or exogenous nucleic acid molecule encoding an enzyme having L-serine decarboxylase activity that catalyzes the conversion of L-serine to ethanolamine;

(f) at least one endogenous or exogenous nucleic acid molecule encoding an enzyme having hydroxypyruvate decarboxylase activity that catalyzes the conversion of hydroxypyruvate from (c) and/or (d) to glycolaldehyde;

(g) at least one endogenous or exogenous nucleic acid molecule encoding an enzyme having ethanolamine aminotransferase or ethanolamine oidoreductase (deaminating) activity that catalyzes the conversion of ethanolamine from (e) to glycolaldehyde;

(h) at least one endogenous or exogenous nucleic acid molecule encoding an enzyme having glycerate decarboxylase activity that catalyzes the conversion of glycerate from (a) and/or (b) to MEG;

(i) at least one endogenous or exogenous nucleic acid molecule encoding an enzyme having glycolaldehyde reductase activity that catalyzes the conversion of glycolaldehyde from (f) and/or (g) to MEG;

(j) at least one endogenous or exogenous nucleic acid molecule encoding an enzyme having glycolaldehyde dehydrogenase activity that catalyzes the conversion of glycolaldehyde from (f) and/or (g) to glycolic acid;
wherein the produced intermediate G3P from embodiment [mA] or from embodiment [mB] is converted to 3-phosphoglycerate and/or 2-phosphoglycerate through endogenous glycolysis in the recombinant microorganism, and wherein MEG (or glycolic acid) is produced.

In another aspect, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to one or more co-product via a C3 pathway.

Co-Production of MEG Via a C2 Pathway and Acetone, Isopropanol, Propene and/or Isobutene Via a C3 Pathway In some embodiments, MEG is produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to acetone via a C3 pathway. Wherein the pentose-phosphate intermediate is D-ribose-5-phosphate, D-ribulose-5-phosphate or D-xylulose-5-phosphate.

[mM] In one embodiment, the application relates to a method of producing a recombinant microorganism capable of co-producing monoethylene glycol (MEG) and acetone from one or more pentose and/or hexose sugars, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (c):

(a) at least one endogenous or exogenous nucleic acid molecule encoding an enzyme having thiolase or acetyl coenzyme A acetyltransferase activity that catalyzes the conversion of acetyl-CoA to acetoacetyl-CoA;

(b) at least one endogenous or exogenous nucleic acid molecule encoding an enzyme having acetyl-CoA:acetoacetate-CoA transferase activity or an enzyme having acetate:acetoacetyl-CoA hydrolase activity that catalyzes the conversion of acetoacetyl-CoA from (a) to acetoacetate; and/or (c) at least one endogenous or exogenous nucleic acid molecule encoding an enzyme having acetoacetate decarboxylase activity that catalyzes the conversion of acetoacetate from (b) to acetone;
wherein the produced intermediate G3P from embodiment [mA] or from embodiment [mB] is converted to acetyl-CoA through endogenous glycolysis in the microorganism, and wherein MEG (or glycolic acid) and acetone are co-produced.

In some embodiments, MEG is produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to isobutene via a C3 pathway. wherein the pentose-phosphate intermediate is D-ribose-5-phosphate, D-ribulose-5-phosphate or D-xylulose-5-phosphate.

[mN] In some embodiments, the application relates to a method of producing a recombinant microorganism capable of co-producing monoethylene glycol (MEG) and isobutene from one or more pentose and/or hexose sugars, wherein the method of embodiment [mA] or from embodiment [mB] (and optionally comprising embodiment [mC]), and having additionally embodiment [mD] for production of MEG in a C2 pathway, further comprises introducing into or expressing in the recombinant microorganism one or more of the following from (a) to (d):

(a) at least one endogenous or exogenous nucleic acid molecule encoding an enzyme having thiolase or acetyl coenzyme A acetyltransferase activity that catalyzes the conversion of acetyl-CoA to acetoacetyl-CoA;

(b) at least one endogenous or exogenous nucleic acid molecule encoding an enzyme having acetyl-CoA:acetoacetate-CoA transferase activity or an enzyme having acetate:acetoacetyl-CoA hydrolase activity that catalyzes the conversion of acetoacetyl-CoA from (a) to acetoacetate;

(c) at least one endogenous or exogenous nucleic acid molecule encoding an enzyme having acetoacetate decarboxylase activity that catalyzes the conversion of acetoacetate from (b) to acetone;

(d) at least one endogenous or exogenous nucleic acid molecule encoding an enzyme having 3-hydroxyisovalerate synthase activity that catalyzes the conversion of acetone from (c) and acetyl-CoA to 3-hydroxyisovalerate (3HIV);
or
wherein the method comprises introducing into or expressing in the recombinant microorganism one or more of the following from (e) to (j):

(e) at least one endogenous or exogenous nucleic acid molecule encoding an enzyme having thiolase or acetyl coenzyme A acetyltransferase activity that catalyzes the conversion of acetyl-CoA to acetoacetyl-CoA;

(f) at least one endogenous or exogenous nucleic acid molecule encoding an enzyme having hydroxymethylglutaryl-CoA synthase activity that catalyzes the conversion of acetoacetyl-CoA from (e) and acetyl-CoA to 3-hydroxy-3-methylglutaryl-CoA (HMG-CoA);

(g) at least one endogenous or exogenous nucleic acid molecule encoding an enzyme having methylglutaconyl-CoA hydratase activity that catalyzes the conversion of HMG-CoA from (f) to 3-methylglutaconyl-CoA;

(h) at least one endogenous or exogenous nucleic acid molecule encoding an enzyme having methylcrotonyl-CoA carboxylase activity that catalyzes the conversion of 3-methylglutaconyl-CoA from (g) to 3-methylcrotonyl-CoA;

(i) at least one endogenous or exogenous nucleic acid molecule encoding an enzyme having methylcrotonyl-CoA hydratase activity that catalyzes the conversion of 3-methylcrotonyl-CoA from (h) to 3-hydroxyisovaleryl-CoA;

(j) at least one endogenous or exogenous nucleic acid molecule encoding an enzyme having 3-hydroxyisovaleryl-CoA thioesterase activity that catalyzes the conversion of 3-hydroxyisovaleryl-CoA from (i) to 3HIV, wherein the method further comprises introducing into or expressing in the recombinant microorganism (a1) and (a2), and/or (b1) selected from:

(a1) at least one endogenous or exogenous nucleic acid molecule encoding an enzyme having 3HIV kinase activity that catalyzes the conversion of 3HIV from (d) or (j) to 3HIV-3-phosphate;

(a2) at least one endogenous or exogenous nucleic acid molecule encoding an enzyme having 3HIV-3-phosphate decarboxylase activity that catalyzes the conversion of 3HIV-3-phosphate from (a1) to isobutene;

(b1) at least one endogenous or exogenous nucleic acid molecule encoding a an enzyme having 3HIV decarboxylase activity that catalyzes the conversion of 3HIV from (d) or (j) to isobutene;

wherein the produced intermediate G3P from embodiment [mA] or from embodiment [mB] is converted to acetyl-CoA through endogenous glycolysis in the microorganism, and wherein MEG and isobutene are co-produced.

In some embodiments, MEG is produced from the lossless transformation of one or more pentose and/or hexose sugars to D-ribose-5-phosphate intermediate, followed by a conversion of the D-ribose-5-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to isopropanol via a C3 pathway.

[mO] In one embodiment, the methods of embodiments [mM] and/or [mN] (optionally comprising embodiment [mEE]), optionally further comprises introducing into or expressing in the recombinant microorganism at least one endogenous or exogenous nucleic acid molecule encoding an enzyme having secondary alcohol dehydrogenase activity that catalyzes the conversion of acetone to isopropanol.

In some embodiments, MEG is produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to propene via a C3 pathway. Wherein the pentose-phosphate intermediate is D-ribose-5-phosphate, D-ribulose-5-phosphate or D-xylulose-5-phosphate.

[mP] In another embodiment, the method of embodiment [mO] (optionally comprising embodiment [mEE]), optionally further comprises at least one endogenous or exogenous nucleic acid molecule encoding an enzyme having dehydratase activity that catalyzes the conversion of isopropanol to propene.

Co-Production of MEG Via a C2 Pathway and One or More Serine Pathway Compound Via a C3 Pathway In some embodiments, MEG and L-serine are co-produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to Lserine via one or more C3 pathways. Wherein the pentose-phosphate intermediate is D-ribose-5-phosphate, D-ribulose-5-phosphate or D-xylulose-5-phosphate.

[mQ] In one embodiment, the application relates to a method of producing a recombinant microorganism capable of co-producing monoethylene glycol (MEG) and L-serine from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (h):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having 3-phosphoglycerate phosphatase activity and/or an enzyme having glycerate 3-kinase activity that catalyzes the conversion of 3-phosphoglycerate to glycerate;

(c) at least one endogenous or exogenous nucleic acid molecule encoding an enzyme having 2-phosphoglycerate phosphatase activity and/or an enzyme having glycerate 2-kinase activity that catalyzes the conversion of 2-phosphoglycerate to glycerate;

(d) at least one endogenous or exogenous nucleic acid molecule encoding an enzyme having phosphoserine aminotransferase activity that catalyzes the conversion of 3-phosphohydroxypyruvate from (a) to phospho-L-serine;

(e) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(f) at least one endogenous or exogenous nucleic acid molecule encoding an enzyme having phosphoserine phosphatase activity that catalyzes the conversion of phospho-L-serine from (d) to L-serine;

(g) at least one endogenous or exogenous nucleic acid molecule encoding an enzyme having hydroxypyruvate reductase activity that catalyzes the conversion of glycerate from (b) and/or (c) to hydroxypyruvate;

(h) at least one endogenous or exogenous nucleic acid molecule encoding an enzyme having serine-pyruvate aminotransferase activity that catalyzes the conversion of hydroxypyruvate from (e) and/or (g) to L-serine;

wherein the produced intermediate G3P from embodiment [mA] or from embodiment [mB] is converted to 3-phosphoglycerate and/or 2-phosphoglycerate through endogenous glycolysis in the microorganism, and wherein MEG and L-serine are produced.

In some embodiments, MEG and glycine are co-produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to glycine via one or more C3 pathways. Wherein the pentose-phosphate intermediate is D-ribose-5-phosphate, D-ribulose-5-phosphate or D-xylulose-5-phosphate.

[mR] In one embodiment, the application relates to a method of producing a recombinant microorganism capable of co-producing monoethylene glycol (MEG) and glycine from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (e):

(a) at least one endogenous or exogenous nucleic acid molecule encoding an enzyme having serine hydroxymethyltransferase activity that catalyzes the conversion of L-serine and tetrahydrofolate (THF) to glycine and 5,10-methylene tetrahydrofolate (M-THF);

(b) at least one endogenous or exogenous nucleic acid molecule encoding an enzyme having transferase activity that catalyzes the conversion of M-THF from (a) to formaldehyde;

(c) at least one endogenous or exogenous nucleic acid molecule encoding an enzyme having formaldehyde dehydrogenase activity that catalyzes the conversion of formaldehyde from (b) to formate and NADH;

(d) at least one endogenous or exogenous nucleic acid molecule encoding an enzyme having formate dehydrogenase activity that catalyzes the conversion of formate from (c) to $CO_2$ and NADH;

(e) at least one endogenous or exogenous nucleic acid molecule encoding a protein of the glycine cleavage system that catalyze the conversion of M-THF from (a), $CO_2$, $NH_3$ and NADH from (c) or (d) to glycine and THF;

wherein THF is reconstituted from steps (b) through (e), wherein optionally formate from (c) is further oxidized to $CO_2$ and $H_2$ by a formate hydrogenlyase complex, and wherein MEG and glycine are produced.

[mS] In one embodiment, the application relates to a method of producing a recombinant microorganism capable of co-producing monoethylene glycol (MEG) and glycine from one or more pentose and/or hexose sugars and a nitrogen source, wherein the recombinant microorganism from embodiment [mA] or from embodiment [mB] (and optionally comprising embodiment [mC]), and having additionally embodiment [mD] for production of MEG in a C2 pathway, further comprises introducing into or expressing in the recombinant microorganism one or more of the following from (a) to (k):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having phosphoserine aminotransferase activity that catalyzes the conversion of 3-phosphohydroxypyruvate from (a) to phospho-L-serine;

(c) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(d) at least one endogenous or exogenous nucleic acid molecule encoding an enzyme having phosphoserine phosphatase activity that catalyzes the conversion of phospho-L-serine from (b) to L-serine;

(e) at least one endogenous or exogenous nucleic acid molecule encoding an enzyme having L-serine transaminase or serine oxidase activity that catalyzes the conversion of L-serine from (d) to hydroxypyruvate;

(f) at least one endogenous or exogenous nucleic acid molecule encoding an enzyme having hydroxypyruvate decarboxylase activity that catalyzes the conversion of hydroxypyruvate from (c) or (e) to glycolaldehyde;

(g) at least one endogenous or exogenous nucleic acid molecule encoding an enzyme having glycolaldehyde dehydrogenase activity that catalyzes the conversion of glycolaldehyde from (f) to glycolic acid;

(h) at least one endogenous or exogenous nucleic acid molecule encoding an enzyme having glycolate dehydrogenase activity that catalyzes the conversion of glycolic acid from (g) to glyoxylate;

(i) at least one endogenous or exogenous nucleic acid molecule encoding an enzyme having alanine-glyoxylate aminotransferase activity that catalyzes the conversion of glyoxylate from (h) and alanine to glycine and pyruvate;

(j) at least one endogenous or exogenous nucleic acid molecule encoding an enzyme having alanine transaminase activity that catalyzes the conversion of pyruvate from (i) and glutamate to alanine and 2-oxoglutarate;

(k) at least one endogenous or exogenous nucleic acid molecule encoding an enzyme having NAD(P)H dependent glutamate dehydrogenase activity that catalyzes the conversion of 2-oxoglutarate from (j) and ammonia to glutamate; wherein the produced intermediate G3P from embodiment [mA] or from embodiment [mB] is converted to 3-phosphoglycerate and/or 2-phosphoglycerate through endogenous glycolysis in the microorganism, wherein alanine and glutamate are reconstituted from steps (j) and (k), and wherein MEG and glycine are co-produced.

[mT] In one embodiment, the application relates to a method of producing a recombinant microorganism capable of co-producing monoethylene glycol (MEG) and glycine from one or more pentose and/or hexose sugars and a nitrogen source, wherein the recombinant microorganism from embodiment [mA] or from embodiment [mB] (and optionally comprising embodiment [mC]), and having additionally embodiment [mD] for production of MEG in a C2 pathway, further comprises introducing into or expressing in the recombinant microorganism one or more of the following from (a) to (l):

(a) at least one endogenous or exogenous nucleic acid molecule encoding an enzyme having 2-phosphoglycerate phosphatase activity and/or an enzyme having glycerate-2-kinase activity that catalyzes the conversion of 2-phosphoglycerate to glycerate;

(b) at least one endogenous or exogenous nucleic acid molecule encoding an enzyme having 3-phosphoglycerate phosphatase activity and/or an enzyme having glycerate-3-kinase activity that catalyzes the conversion of 3-phosphoglycerate to glycerate;

(c) at least one endogenous or exogenous nucleic acid molecule encoding an enzyme having hydroxypyruvate reductase activity that catalyzes the conversion of glycerate from (a) and/or (b) to hydroxypyruvate;

(d) at least one endogenous or exogenous nucleic acid molecule encoding an enzyme having serine aminotransferase or serine oxidoreductase (deaminating) activity that catalyzes the conversion of L-serine to hydroxypyruvate;

(e) at least one endogenous or exogenous nucleic acid molecule encoding an enzyme having L-serine decarboxylase activity that catalyzes the conversion of L-serine to ethanolamine;

(f) at least one endogenous or exogenous nucleic acid molecule encoding an enzyme having hydroxypyruvate decarboxylase activity that catalyzes the conversion of hydroxypyruvate from (c) and/or (d) to glycolaldehyde;

(g) at least one endogenous or exogenous nucleic acid molecule encoding an enzyme having ethanolamine aminotransferase activity or an enzyme having ethanolamine oidoreductase (deaminating) activity that catalyzes the conversion of ethanolamine from (e) to glycolaldehyde;

(h) at least one endogenous or exogenous nucleic acid molecule encoding an enzyme having glycolaldehyde dehydrogenase activity that catalyzes the conversion of glycolaldehyde from (f) and/or (g) to glycolic acid;

(i) at least one endogenous or exogenous nucleic acid molecule encoding an enzyme having glycolate dehydrogenase activity that catalyzes the conversion of glycolic acid from (g) to glyoxylate;

(j) at least one endogenous or exogenous nucleic acid molecule encoding an enzyme having alanine-glyoxylate aminotransferase activity that catalyzes the conversion of glyoxylate from (i) and alanine to glycine and pyruvate;

(k) at least one endogenous or exogenous nucleic acid molecule encoding an enzyme having alanine transaminase activity that catalyzes the conversion of pyruvate from (j) and glutamate to alanine and 2-oxoglutarate;

(l) at least one endogenous or exogenous nucleic acid molecule encoding an enzyme having NAD(P)H dependent glutamate dehydrogenase activity that catalyzes the conversion of 2-oxoglutarate from (k) and ammonia to glutamate; wherein the produced intermediate G3P from embodiment [mA] or from embodiment [mB] is converted to 3-phosphoglycerate and/or 2-phosphoglycerate through endogenous glycolysis in the microorganism, wherein alanine and glutamate are reconstituted from steps (k) and (l), and wherein MEG and glycine are co-produced.

In some embodiments, MEG and MEA are co-produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to MEA via one or more C3 pathways. Wherein the pentose-phosphate intermediate is D-ribose-5-phosphate, D-ribulose-5-phosphate or D-xylulose-5-phosphate.

[mU] In one embodiment, the application relates to a method of producing a recombinant microorganism capable of co-producing monoethylene glycol (MEG) and MEA from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (i):

(a) at least one endogenous or exogenous nucleic acid molecule encoding an enzyme having 3-phosphoglycerate dehydrogenase activity that catalyzes the conversion of 3-phosphoglycerate to 3-phosphohydroxypyruvate;

(b) at least one endogenous or exogenous nucleic acid molecule encoding an enzyme having 3-phosphoglycerate phosphatase activity and/or an enzyme having glycerate 3-kinase activity that catalyzes the conversion of 3-phosphoglycerate to glycerate;

(c) at least one endogenous or exogenous nucleic acid molecule encoding an enzyme having 2-phosphoglycerate phosphatase activity and/or an enzyme having glycerate 2-kinase activity that catalyzes the conversion of 2-phosphoglycerate to glycerate;

(d) at least one endogenous or exogenous nucleic acid molecule encoding an enzyme having phosphoserine aminotransferase activity that catalyzes the conversion of 3-phosphohydroxypyruvate from (a) to phospho-L-serine;

(e) at least one endogenous or exogenous nucleic acid molecule encoding an enzyme having 3-phosphohydroxypyruvate phosphatase activity that catalyzes the conversion of 3-phosphohydroxypyruvate from (a) to hydroxypyruvate;

(f) at least one endogenous or exogenous nucleic acid molecule encoding an enzyme having phosphoserine phosphatase activity that catalyzes the conversion of phospho-L-serine from (d) to L-serine;

(g) at least one endogenous or exogenous nucleic acid molecule encoding an enzyme having hydroxypyruvate reductase activity that catalyzes the conversion of glycerate from (b) and/or (c) to hydroxypyruvate;

(h) at least one endogenous or exogenous nucleic acid molecule encoding an enzyme having serine-pyruvate aminotransferase activity that catalyzes the conversion of hydroxypyruvate from (e) and/or (g) to L-serine;

(i) at least one endogenous or exogenous nucleic acid molecule encoding an enzyme having serine decarboxylase activity that catalyzes the conversion of L-serine from (f) and/or (h) to MEA;
wherein the produced intermediate G3P from embodiment [mA] or from embodiment [mB] is converted to 3-phosphoglycerate and/or 2-phosphoglycerate through endogenous glycolysis in the microorganism, and wherein MEG and MEA are co-produced.

[mV] In one embodiment, the application relates to a method of producing a recombinant microorganism capable of co-producing monoethylene glycol (MEG) and MEA from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (f):

(a) at least one endogenous or exogenous nucleic acid molecule encoding an enzyme having 2-phosphoglycerate phosphatase activity and/or an enzyme having glycerate-2-kinase activity that catalyzes the conversion of 2-phosphoglycerate to glycerate;

(b) at least one endogenous or exogenous nucleic acid molecule encoding an enzyme having 3-phosphoglycerate phosphatase activity and/or an enzyme having glycerate-3-kinase activity that catalyzes the conversion of 3-phosphoglycerate to glycerate;

(c) at least one endogenous or exogenous nucleic acid molecule encoding an enzyme having hydroxypyruvate reductase activity that catalyzes the conversion of glycerate from (a) and/or (b) to hydroxypyruvate;

(d) at least one endogenous or exogenous nucleic acid molecule encoding an enzyme having serine-pyruvate aminotransferase or serine oxidoreductase (deaminating) activity that catalyzes the conversion of L-serine to hydroxypyruvate;

(e) at least one endogenous or exogenous nucleic acid molecule encoding an enzyme having hydroxypyruvate decarboxylase activity that catalyzes the conversion of hydroxypyruvate from (c) and/or (d) to glycolaldehyde;

(f) at least one endogenous or exogenous nucleic acid molecule encoding an enzyme having transaminase activity that catalyzes the conversion of glycolaldehyde from (e) to MEA;
wherein the produced intermediate G3P from embodiment [mA] or from embodiment [mB] is converted to 3-phosphoglycerate and/or 2-phosphoglycerate through endogenous glycolysis in the microorganism, and wherein MEG and MEA are co-produced.

[mW] In one embodiment, the application relates to a method of producing a recombinant microorganism capable of co-producing monoethylene glycol (MEG) and MEA from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (b):

(a) at least one endogenous or exogenous nucleic acid molecule encoding an enzyme having acetaldehyde dehydrogenase activity that catalyzes the conversion of acetyl-CoA to acetaldehyde;

(b) at least one endogenous or exogenous nucleic acid molecule encoding an enzyme having ethanolamine ammonia lyase activity that catalyzes the conversion of acetaldehyde and ammonia to MEA;

wherein the produced intermediate G3P from embodiment [mA] or from embodiment [mB] is converted to acetyl-CoA through endogenous glycolysis in the recombinant microorganism, and wherein MEG and MEA are co-produced.

In some embodiments, MEG and EDA are co-produced from the lossless transformation of one or more pentose and/or hexose sugars to pentose-phosphate intermediate, followed by a conversion of the pentose-phosphate intermediate to glycolaldehyde and D-glyceraldehyde-3-phosphate (G3P) intermediates, followed by a conversion of the glycolaldehyde intermediate to MEG via a C2 pathway, and a conversion of G3P intermediate to EDA via one or more C3 pathways. Wherein the pentose-phosphate intermediate is D-ribose-5-phosphate, D-ribulose-5-phosphate or D-xylulose-5-phosphate.

[mX] In one embodiment, the application relates to a method of producing a recombinant microorganism capable of co-producing monoethylene glycol (MEG) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (c):

(a) at least one endogenous or exogenous nucleic acid molecule encoding an enzyme having serine dehydrogenase activity that catalyzes the conversion of L-serine to 2-aminomalonate semialdehyde;

(b) at least one endogenous or exogenous nucleic acid molecule encoding an enzyme having 2-aminomalonate semialdehyde decarboxylase activity that catalyzes the conversion of 2-aminomalonate semialdehyde from (a) to aminoacetaldehyde;

(c) at least one endogenous or exogenous nucleic acid molecule encoding an enzyme having aminoacetaldehyde transaminase activity that catalyzes the conversion of aminoacetaldehyde from (b) to EDA;

wherein 2-aminomalonate semialdehyde may optionally be converted to aminoacetaldehyde by a spontaneous reaction, and wherein MEG and EDA are co-produced.

[mY] In one embodiment, the application relates to a method of producing a recombinant microorganism capable of co-producing monoethylene glycol (MEG) (or glycolic acid) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (c):

(a) at least one endogenous or exogenous nucleic acid molecule encoding an enzyme having serine dehydrogenase activity that catalyzes the conversion of L-serine to 2-aminomalonate semialdehyde;

(b) at least one endogenous or exogenous nucleic acid molecule encoding an enzyme having 2-aminomalonate semialdehyde transaminase activity that catalyzes the conversion of 2-aminomalonate semialdehyde from (a) to 2,3-diaminopropanoate;

(c) at least one endogenous or exogenous nucleic acid molecule encoding an enzyme having 2,3-diaminopropanoate decarboxylase activity that catalyzes the conversion of 2,3-diaminopropanoate from (b) to EDA;

wherein MEG and EDA are co-produced.

[mZ] In one embodiment, the application relates to a method of producing a recombinant microorganism capable of co-producing monoethylene glycol (MEG) (or glycolic acid) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (c):

(a) at least one endogenous or exogenous nucleic acid molecule encoding an enzyme having serine decarboxylase activity that catalyzes the conversion of L-serine to ethanolamine;

(b) at least one endogenous or exogenous nucleic acid molecule encoding an enzyme having ethanolamine dehydrogenase activity that catalyzes the conversion of ethanolamine from (a) to aminoacetaldehyde;

(c) at least one endogenous or exogenous nucleic acid molecule encoding an enzyme having aminoacetaldehyde transaminase activity that catalyzes the conversion of aminoacetaldehyde from (b) to EDA;

wherein MEG and EDA are co-produced.

[mAA] In one embodiment, the application relates to a method of producing a recombinant microorganism capable of co-producing monoethylene glycol (MEG) (or glycolic acid) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (c):

(a) at least one endogenous or exogenous nucleic acid molecule encoding an enzyme having serine hydroxymethyltransferase activity that catalyzes the conversion of L-serine to glycine;

(b) at least one endogenous or exogenous nucleic acid molecule encoding an enzyme having aldehyde oxidase activity that catalyzes the conversion of glycine from (a) to aminoacetaldehyde;

(c) at least one endogenous or exogenous nucleic acid molecule encoding an enzyme having aminoacetaldehyde transaminase activity that catalyzes the conversion of aminoacetaldehyde from (b) to EDA;

wherein MEG and EDA are co-produced.

[mBB] In one embodiment, the application relates to a method of producing a recombinant microorganism capable of co-producing monoethylene glycol (MEG) (or glycolic acid) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (e):

(a) at least one endogenous or exogenous nucleic acid molecule encoding an enzyme having an amino acid N-acetyl transferase activity or O-acetyl transferase activity that catalyzes the conversion of L-serine to N-acetylserine;

(b) at least one endogenous or exogenous nucleic acid molecule encoding an enzyme having N-acetylserine dehydrogenase activity that catalyzes the conversion of N-acetylserine from (a) to N-acetylmalonate semialdehyde;

(c) at least one endogenous or exogenous nucleic acid molecule encoding an enzyme having transaminase activity that catalyzes the conversion of N-acetylmalonate semialdehyde from (b) to acetylaminopropanoate;

(d) at least one endogenous or exogenous nucleic acid molecule encoding an enzyme having deacetylase activity that catalyzes the conversion of acetylaminopropanoate from (c) to 2,3-diaminopropanoate;

(e) at least one endogenous or exogenous nucleic acid molecule encoding an enzyme having 2,3-diaminopropanoate decarboxylase activity that catalyzes the conversion of 2,3-diaminopropanoate from (d) to EDA;

wherein MEG and EDA are co-produced.

[mCC] In one embodiment, the application relates to a method of producing a recombinant microorganism capable of co-producing monoethylene glycol (MEG) (or glycolic acid) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (b):

(a) at least one endogenous or exogenous nucleic acid molecule encoding an enzyme having a serine aminase activity that catalyzes the conversion of L-serine to (S)-2,3-diaminopropanoate;

(b) at least one endogenous or exogenous nucleic acid molecule encoding an enzyme having an (S)-2,3-diaminopropanoate decarboxylase activity that catalyzes the conversion of (S)-2,3-diaminopropanoate from (a) to EDA;

wherein MEG and EDA are co-produced.

[mDD] In one embodiment, the application relates to a method of producing a recombinant microorganism capable of co-producing monoethylene glycol (MEG) (or glycolic acid) and ethylenediamine (EDA), from one or more pentose and/or hexose sugars and a nitrogen source, wherein the method of embodiment [mA] or embodiment [mB] (and optionally comprising embodiment [mC]), and having additionally embodiment [mD] for production of MEG in a C2 pathway, further comprises introducing into or expressing in the recombinant microorganism one or more of the following from (a) to (b):

(a) at least one endogenous or exogenous nucleic acid molecule encoding an enzyme having an (S)-2,3-diaminopropanoate ammonia lyase activity that catalyzes the conversion of pyruvate and ammonium to (S)-2,3-diaminopropanoate;

(b) at least one endogenous or exogenous nucleic acid molecule encoding an enzyme having (S)-2,3-diaminopropanoate decarboxylase activity that catalyzes the conversion of (S)-2,3-diaminopropanoate from (a) to EDA;

wherein G3P is converted to pyruvate via endogenous glycolysis in the recombinant microorganism, and wherein MEG and EDA are co-produced.

[mEE] In another embodiment, the method of embodiment [mD] or embodiment [mE], optionally further comprises introducing one or more modifications selected from the group consisting of:

(i) a deletion, insertion, or loss of function mutation in a gene encoding a glycolaldehyde reductase that catalyzes the conversion of glycolaldehyde to monoethyleneglycol (MEG);

(ii) a deletion, insertion, or loss of function mutation in a gene encoding a glycolaldehyde dehydrogenase that catalyzes the conversion of glycolaldehyde to glycolic acid; and (iii) a deletion, insertion, or loss of function mutation in a gene encoding a lactate dehydrogenase that catalyzes the conversion of pyruvate to lactate.

Enzyme Engineering

The enzymes in the recombinant microorganism can be engineered to improve one or more aspects of the substrate to product conversion. Non-limiting examples of enzymes that can be further engineered for use in methods of the disclosure include a D-ribose-5-phosphate aldolase, a transketolase, a transaldolase, an aldehyde reductase, an acetoacetyl coenzyme A hydrolase, a xylose isomerase, a 3-phosphoglycerate dehydrogenase, a phosphoserine aminotransferase, a 3-phosphohydroxypyruvate phosphatase, a phosphoserine phosphatase, a serine transaminase, a hydroxypyruvate decarboxylase, a 3-phosphohydroxypyruvate reductase, a glycolaldehyde dehydrogenase, a serine oxidoreductase (deaminating) or serine-pyruvate aminotransferase, a serine decarboxylase, an ethanolamine aminotransferase or ethanolamine oxidoreductase (deaminating), a glycerate decarboxylase, a hydroxypyruvate reductase, a 3-phosphoglycerate phosphatase, a 2-phosphoglycerate phosphatase, a glycerate 3-kinase, a glycerate 2-kinase, a mevalonate diphosphate decarboxylase, and combinations thereof. These enzymes can be engineered for improved catalytic activity, improved selectivity, improved stability, improved tolerance to various fermentation conditions (temperature, pH, etc.), or improved tolerance to various metabolic substrates, products, by-products, intermediates, etc. The term "improved catalytic activity" as used herein with respect to a particular enzymatic activity refers to a higher level of enzymatic activity than that measured relative to a comparable non-engineered enzyme.

Directed evolution is a term used to describe the entire range of molecular biology techniques that allow natural evolutionary processes to be mimicked in the laboratory. For enzymes, this generally involves the random mutagenesis of one or more starting genes, followed by a screening or selection step to isolate or enrich for enzyme variants with improvements in one or more desirable properties. The process can be iterated until the desired level of change is reached, or until no further change is elicited. A wide range of tools and techniques have been developed over more than two decades to shorten the process from the millions of years taken by nature, to just weeks or months in the laboratory. The most common strategies mimic the mechanisms of evolution that occur in nature, such as error-prone PCR (epPCR), which introduces random point mutations in a population of DNA products, and DNA shuffling techniques, which allow random recombination typically between parent genes with >70% homology. Later techniques accessed a wider range of amino acids through saturation or cassette mutagenesis targeted to pre-chosen sites or at randomly distributed sites, and enabled the random recombination of non-homologous genes. Further techniques can create random insertions and deletions of codons, shuffle domains or exons, or loop regions, and produce a library of random truncations.

For example, engineering methods have been used to alter the stability, substrate specificity and stereospecificity of aldolases to produce excellent enzymes for biocatalytic processes. The thermostability and solvent tolerance of fructose-1,6-bisphosphate aldolase (FBP-aldolase) was increased using family DNA shuffling of the fda genes from *Escherichia coli* and *Edwardsiella ictaluri*. A fourth generation variant was identified which displayed an average 280-fold higher half-life at 53° C. than either parent. The same variant also displayed enhanced activity in various polar and non-polar organic solvents (Hao and Berry 2004 Protein Eng Des Sel 17:689-697).

As another example, acetoacetyl coenzyme A hydrolase can convert acetoacetyl-CoA to acetoacetate. However, the hydrolase is unspecific in that it also reacts with the same magnitude of order with acetyl-CoA, which is the substrate required for acetoacetyl-CoA formation by the enzyme thiolase. Thus, to create more efficient acetoacetyl-CoA hydrolases, these enzymes have been engineered to have at least 10× higher activity for the acetoacetyl-CoA substrate than for acetyl-CoA substrate by replacing several glutamic acid residues in the enzyme beta subunit that is important for catalysis (WO 2015/042588).

As another example, the *E. coli* YqhD enzyme is a broad substrate aldehyde reductase with NADPH-dependent reductase activity for more than 10 aldehyde substrates and is a useful enzyme to produce biorenewable fuels and chemicals (Jarboe 2010 *Applied Microbiology and Biotechnology* 89:249). Though YqhD enzyme activity is beneficial through its scavenging of toxic aldehydes, the enzyme is also NADPH-dependent and contributes to NADPH depletion and growth inhibition of organisms. Error-prone PCR of YqhD was performed in order to improve 1,3-propanediol production from 3-hydroxypropionaldehyde (3-HPA). This directed engineering yielded two mutants, D99QN147H and Q202A, with decreased Km and increased kcat for certain aldehydes, particularly 3-HPA (Li et al. 2008 Prog. Nat. Sci. 18 (12):1519-1524). The improved catalytic activity of the D99QN147H mutant is consistent with what is known about the structure of YqhD (Sulzenbacher et al. 2004 J. Mol. Biol. 342 (2):489-502), as residues Asp99 and Asn147 both interact with NADPH. Use of the D99QN147H mutant increased 1,3-propanediol production from 3-HPA 2-fold. Mutant YqhD enzymes with increased catalytic efficiency (increased Kcat/Km) toward NADPH have also been described in WO 2011012697 A2, which is herein incorporated in its entirety.

As another example, xylose isomerase is a metal-dependent enzyme that catalyzes the interconversion of aldose and ketose sugars, primarily between xylose to xylulose and glucose to fructose. It has lower affinity for lyxose, arabinose and mannose sugars. The hydroxyl groups of sugars may define the substrate preference of sugar isomerases. The aspartate at residue 256 of *Thermus thermophilus* xylose isomerase was replaced with arginine (Patel et al. 2012 Protein Engineering, Design & Selection vol. 25 no. 7 pp. 331-336). This mutant xylose isomerase exhibited an increase in specificity for D-lyxose, L-arabinose and D-mannose. The catalytic efficiency of the D256R xylose isomerase mutant was also higher for these 3 substrates compared to the wild type enzyme. It was hypothesized that the arginine at residue 256 in the mutant enzyme may play a role in the catalytic reaction or influence changes in substrate orientation.

As another example, the enzyme xylitol dehydrogenase plays a role in the utilization of xylose along with xylose reductase. Xylose reductase (XR) reduces xylose to xylitol and then xylitol dehydrogenase (XDH) reoxidizes xylitol to form xylulose. However, since XR prefers NADPH as cosubstrate, while XDH exclusively uses NAD+ as cosubstrate, a cosubstrate recycling problem is encountered. One solution is to engineer XDH such that its cosubstrate specificity is altered from NAD+ to NADP+ (Ehrensberger et al. 2006 Structure 14: 567-575). A crystal structure of the *Gluconobacter oxydans* holoenzyme revealed that Asp38 is largely responsible for the NAD+ specificity of XDH. Asp38 interacts with the hydroxyls of the adenosine ribose, and Met39 stacks under the purine ring and is also located near the 2' hydroxyl. A double mutant (D38S/M39R) XDH was constructed that exclusively used NADP+ without loss of enzyme activity.

As another example, the enzyme mevalonate diphosphate decarboxylase (MVD) is an ATP-dependent enzyme which catalyzes the phosphorylation/decarboxylation of (R)-mevalonate-5-diphosphate to isopentenyl pyrophosphate (IPP) in the mevalonate (MVA) pathway. In the classical MVA pathway, MVD catalyzes the final step, where it produces IPP from (R)-mevalonate-5-diphosphate (MVAPP) in an irreversible reaction dependent upon ATP. MVAPP is phosphorylated first, and consequent decarboxylation occurs with the concomitant release of inorganic phosphate. With the same mechanism, classical MVDs also catalyze the conversion of the nonphosphorylated 3-hydroxyisovalerate (3-HIV) to isobutene. Mevalonate diphosphate (MDP) decarboxylase variants having improved activity in converting 3-phosphonoxyisovalerate into isobutene are disclosed in, for example, WO 2012052427 and WO 2015004211, each of which is herein incorporated in its entirety.

Metabolic Engineering—Enzyme Overexpression or Enzyme Downregulation/Deletion for Increased Pathway Flux In various embodiments described herein, the exogenous and endogenous enzymes in the recombinant microorganism participating in the biosynthesis pathways described herein may be overexpressed.

The terms "overexpressed" or "overexpression" refers to an elevated level (e.g., aberrant level) of mRNAs encoding for a protein(s), and/or to elevated levels of protein(s) in cells as compared to similar corresponding unmodified cells expressing basal levels of mRNAs or having basal levels of proteins. In particular embodiments, mRNA(s) or protein(s) may be overexpressed by at least 2-fold, 3-fold, 4-fold, 5-fold, 6-fold, 8-fold, 10-fold, 12-fold, 15-fold or more in microorganisms engineered to exhibit increased gene mRNA, protein, and/or activity.

In some embodiments, a recombinant microorganism of the disclosure is generated from a host that contains the enzymatic capability to synthesize substrates such as D-ribose-5-phosphate, glycolaldehyde, D-glyceraldehyde-3-phosphate, D-xylulose, D-ribulose, D-ribulose-1-phosphate, D-xylulose-1-phosphate, D-ribulose-5-phosphate, D-xylulose-5-phosphate, D-xylonolactone, D-xylonate, 2-keto-3-deoxy-xylonate, glycolaldehyde, DHAP, pyruvate, acetoacetyl-CoA, acetoacetate or 3-hydroxyisovalerate. In some embodiments, it can be useful to increase the synthesis or accumulation of, for example, D-ribose-5-phosphate, glycolaldehyde, D-glyceraldehyde-3-phosphate, D-xylulose, D-ribulose, D-ribulose-1-phosphate, D-xylulose-1-phosphate, D-ribulose-5-phosphate, D-xylulose-5-phosphate, D-xylonolactone, D-xylonate, 2-keto-3-deoxy-xylonate, glycolaldehyde, DHAP, pyruvate, acetoacetyl-CoA, acetoacetate or 3-hydroxyisovalerate, to increase the production of MEG (or GA), or MEG and one or more co-product.

In some embodiments, it may be useful to increase the expression of endogenous or exogenous enzymes involved in the MEG (or GA), or MEG and one or more co-product, biosynthesis pathways to increase flux from, for example, D-ribose-5-phosphate, glycolaldehyde, D-glyceraldehyde-3-phosphate, D-xylulose, D-ribulose, D-ribulose-1-phosphate, D-xylulose-1-phosphate, D-ribulose-5-phosphate, D-xylulose-5-phosphate, D-xylonolactone, D-xylonate, 2-keto-3-deoxy-xylonate, glycolaldehyde, DHAP, pyruvate, acetoacetyl-CoA, acetoacetate or 3-hydroxyisovalerate, thereby resulting in increased synthesis or accumulation of MEG (or GA), or MEG and one or more co-product.

Increased synthesis or accumulation can be accomplished by, for example, overexpression of nucleic acids encoding one or more of the above-described MEG (or GA), or MEG and one or more co-product, biosynthesis pathway enzymes. Overexpression of a MEG (or GA), or MEG and one or more co-product biosynthesis pathway enzyme or enzymes can occur, for example, through increased expression of an endogenous gene or genes, or through the expression, or increased expression, of an exogenous gene or genes. Therefore, naturally occurring organisms can be readily modified to generate non-natural, MEG (or GA), or MEG and one or more co-product, producing microorganisms through overexpression of one or more nucleic acid molecules encoding a MEG (or GA), or MEG and one or more co-product, biosynthesis pathway enzyme. In addition, a non-naturally occurring organism can be generated by mutagenesis of an endogenous gene that results in an increase in activity of an enzyme in the MEG (or GA), or MEG and one or more co-product, biosynthesis pathways.

Equipped with the present disclosure, the skilled artisan will be able to readily construct the recombinant microorganisms described herein, as the recombinant microorganisms of the disclosure can be constructed using methods well known in the art as exemplified above to exogenously express at least one nucleic acid encoding a MEG (or GA), or MEG and one or more co-product, biosynthesis pathway enzyme in sufficient amounts to produce MEG (or GA), or MEG and one or more co-product.

Methods for constructing and testing the expression levels of a non-naturally occurring MEG (or GA), or MEG and one or more co-product producing, host can be performed, for example, by recombinant and detection methods well known in the art. Such methods can be found described in, for example, Sambrook et al., *Molecular Cloning: A Laboratory Manual*, Third Ed., Cold Spring Harbor Laboratory, New York (2001); Ausubo et al., *Current Protocols in Molecular Biology*, John Wiley and Sons, Baltimore, Md. (1999).

A variety of mechanisms known in the art can be used to express, or overexpress, exogenous or endogenous genes. For example, an expression vector or vectors can be constructed to harbor one or more MEG (or GA), or MEG and one or more co-product, biosynthesis pathway enzymes encoding nucleic acids as exemplified herein operably linked to expression control sequences functional in the host organism. Expression vectors applicable for use in the microbial host organisms of the invention include, for example, plasmids, phage vectors, viral vectors, episomes and artificial chromosomes, including vectors and selection sequences or markers operable for stable integration into a host chromosome. Selectable marker genes also can be included that, for example, provide resistance to antibiotics or toxins, complement auxotrophic deficiencies, or supply critical nutrients not in the culture media. Expression control sequences can include constitutive and inducible promoters, transcription enhancers, transcription terminators, and the like which are well known in the art. When two or more exogenous encoding nucleic acids are to be co-expressed, both nucleic acids can be inserted, for example, into a single expression vector or in separate expression vectors. For single vector expression, the encoding nucleic acids can be operationally linked to one common expression control sequence or linked to different expression control sequences, such as one inducible promoter and one constitutive promoter. The transformation of exogenous nucleic acid sequences involved in a metabolic or synthetic pathway can be confirmed using methods well known in the art.

As will be understood by those of skill in the art, it can be advantageous to modify a coding sequence to enhance its expression in a particular host. The genetic code is redundant with 64 possible codons, but most organisms typically use a subset of these codons. The codons that are utilized most often in a species are called optimal codons, and those not utilized very often are classified as rare or low-usage codons. Codons can be substituted to reflect the preferred codon usage of the host, a process sometimes called "codon optimization" or "controlling for species codon bias."

Optimized coding sequences containing codons preferred by a particular prokaryotic or eukaryotic host (see also, Murray et al. (1989) Nucl. Acids Res. 17:477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. For example, typical stop codons for *S. cerevisiae* and mammals are UAA and UGA, respectively. The typical stop codon for monocotyledonous plants is UGA, whereas insects and *E. coli* commonly use UAA as the stop codon (Dalphin et al. (1996) Nucl. Acids Res. 24: 216-218).

Those of skill in the art will recognize that, due to the degenerate nature of the genetic code, a variety of nucleic acid sequences can be used to encode a given enzyme of the disclosure. The nucleic acid sequences encoding the biosynthetic enzymes are referenced herein merely to illustrate an embodiment of the disclosure, and the disclosure includes any nucleic acid sequences that encode the amino acid sequences of the polypeptides and proteins of the enzymes of the present disclosure. In similar fashion, a polypeptide can typically tolerate one or more amino acid substitutions, deletions, and insertions in its amino acid sequence without loss or significant loss of a desired activity. The disclosure includes such polypeptides with different amino acid sequences than the specific proteins described herein so long as the modified or variant polypeptides have the enzymatic anabolic or catabolic activity of the reference polypeptide. Furthermore, the amino acid sequences encoded by the nucleic acid sequences shown herein merely illustrate embodiments of the disclosure.

Expression control sequences are known in the art and include, for example, promoters, enhancers, polyadenylation signals, transcription terminators, internal ribosome entry sites (IRES), and the like, that provide for the expression of the polynucleotide sequence in a host cell. Expression control sequences interact specifically with cellular proteins involved in transcription (Maniatis et al., Science, 236: 1237-1245 (1987)). Exemplary expression control sequences are described in, for example, Goeddel, Gene Expression Technology: Methods in Enzymology, Vol. 185, Academic Press, San Diego, Calif. (1990).

In various embodiments, an expression control sequence may be operably linked to a polynucleotide sequence. By "operably linked" is meant that a polynucleotide sequence and an expression control sequence(s) are connected in such a way as to permit gene expression when the appropriate molecules (e.g., transcriptional activator proteins) are bound to the expression control sequence(s). Operably linked promoters are located upstream of the selected polynucleotide sequence in terms of the direction of transcription and translation. Operably linked enhancers can be located upstream, within, or downstream of the selected polynucleotide.

In some embodiments, the recombinant microorganism is manipulated to delete, disrupt, mutate, and/or reduce the activity of one or more endogenous enzymes that catalyzes a reaction in a pathway that competes with the biosynthesis pathway for the production of MEG (or GA), or MEG and one or more co-product.

In some embodiments, the recombinant microorganism is manipulated to delete, disrupt, mutate, and/or reduce the activity of one or more endogenous enzymes in the oxidative branch of the pentose phosphate pathway. In some embodiments, the manipulation prevents the conversion of glucose-6-phosphate through the oxidative branch of the pentose phosphate pathway and instead shunts glucose-6-phosphate through the non-oxidative branch of the pentose phosphate pathway to produce a pentose-phosphate intermediate needed for the production of MEG (or GA), or MEG and one or more co-product. Wherein the pentose-phosphate intermediate is D-ribose-5-phosphate, D-ribulose-5-phosphate or D-xylulose-5-phosphate. In some such embodiments, the one or more endogenous enzyme is selected from glucose 6-phosphate-1-dehydrogenase, 6-phosphogluconolactonase, and 6-phosphogluconate dehydrogenase. In further embodiments, the glucose 6-phosphate-1-dehydrogenase is zwf, the 6-phosphogluconolactonase is pgl, and the 6-phosphogluconate dehydrogenase is gnd.

In some embodiments, the recombinant microorganism is manipulated to delete, disrupt, mutate, and/or reduce the activity of glyceraldehyde 3-phosphate dehydrogenase. In some embodiments, the manipulation prevents the conversion of glyceraldehyde 3-phosphate to 1,3-bisphospho-D-glycerate and instead allow glyceraldehyde 3-phosphate to be converted to xylulose-5-phosphate (with a concurrent conversion of fructose-6-phosphate to erythrose-4-phosphate) by a transketolase, and thus produce a pentose-phosphate intermediate needed for the production of MEG (or GA), or MEG and one or more co-product, and provide more erythrose-4-phosphate for the non-oxidative branch of the pentose phosphate pathway to further produce a pentose-phosphate intermediate. In some embodiments, the glyceraldehyde 3-phosphate dehydrogenase is gapA. Wherein the pentose-phosphate intermediate is D-ribose-5-phosphate, D-ribulose-5-phosphate or D-xylulose-5-phosphate.

In some embodiments, the recombinant microorganism is manipulated to delete, disrupt, mutate, and/or reduce the activity of 6-phosphofructokinase. In some embodiments, the manipulation prevents the conversion of fructose-6-phosphate to 1,6-bisphosphate and instead allow fructose-6-phosphate to be converted to erythrose-4-phosphate and acetyl-phosphate by a fructose-6-phosphate phosphoketolase, and provide more erythrose-4-phosphate for the non-oxidative branch of the pentose phosphate pathway to further produce a pentose-phosphate intermediate needed for the production of MEG (or GA), or MEG and one or more co-product. In some embodiments, the 6-phosphofructokinase is pfkA and/or pfkB.

In some embodiments, the recombinant microorganism is manipulated to delete, disrupt, mutate, and/or reduce the activity of one or more endogenous enzymes that catalyzes the conversion of glycolaldehyde to glycolic acid. In some such embodiments, the enzyme that catalyzes the conversion of glycolaldehyde to glycolic acid is a glycolaldehyde dehydrogenase. In some embodiments, the glycolaldehyde dehydrogenase is from *Escherichia coli*. In some embodiments, the glycolaldehyde dehydrogenase is encoded by the aldA gene or homologs thereof. In some embodiments, the manipulation prevents the production of glycolic acid from glycolaldehyde and instead shunts the reaction toward conversion of glycolaldehyde to MEG. In some embodiments, the deletion, disruption, mutation, and/or reduction in the activity of one or more endogenous enzymes that catalyzes the conversion of glycolaldehyde to glycolic acid is partial, wherein some glycolaldehyde dehydrogenase function is still present and an amount of glycolic acid is still produced.

In some embodiments, the recombinant microorganism is manipulated to delete, disrupt, mutate, and/or reduce the activity of one or more endogenous enzymes that catalyzes the conversion of pyruvate to lactate. In some such embodiments, the enzyme that catalyzes the conversion of pyruvate to lactate is a lactate dehydrogenase. In some embodiments, the lactate dehydrogenase is from *Escherichia coli*. In some embodiments, the lactate dehydrogenase is encoded by the ldhA gene or homologs thereof. In some embodiments, the manipulation prevents the production of lactate from pyruvate and instead shunts the reaction toward production of MEG (or GA), or MEG and one or more co-product.

In some embodiments, the recombinant microorganism is manipulated to delete, disrupt, mutate, and/or reduce the activity of one or more endogenous enzymes that catalyzes the conversion of glycolaldehyde to monoethyleneglycol (MEG) and instead shunt the reaction toward conversion of glycolaldehyde to glycolic acid (GA). In some embodiments, the enzyme having glycolaldehyde reductase activity is from *Escherichia coli*. In some embodiments, the enzyme having glycolaldehyde reductase activity is encoded by the fucO gene, or homolog thereof.

The foregoing detailed description has been given for clearness of understanding only and no unnecessary limitations should be understood there from as modifications will be obvious to those skilled in the art.

While the disclosure has been described in connection with specific embodiments thereof, it will be understood that it is capable of further modifications and this application is intended to cover any variations, uses, or adaptations of the disclosure following, in general, the principles of the disclosure and including such departures from the present disclosure as come within known or customary practice within the art to which the disclosure pertains and as may be applied to the essential features hereinbefore set forth and as follows in the scope of the appended claims.

The disclosures, including the claims, figures and/or drawings, of each and every patent, patent application, and publication cited herein are hereby incorporated herein by reference in their entireties.

EXAMPLES

Example 1

Generation of 6-his Tagged Constructs for DERA Variants, Pentose Kinases, and Aldehyde Dehydrogenase For deoxy-ribose-5-phosphate aldolase (DERA) constructions, the wild-type genes encoding DERA from *Escherichia coli* (EcDERA or EcdeoC, UniProt accession number P0A6L0)(SEQ ID NO: 255) and from *Bacillus caldolyticus* (BcDERA, or BcdeoC, UniProt accession number A0A2H5KL15)(SEQ ID NO: 286) were synthesized by GenScript (Hong Kong, China) with codon optimization based on the *E. coli* codon for the BcDERA (SEQ ID NO: 287). The two DNA fragments were cloned in pET28 plasmid.

Based on the published DERA sequence (Heine, A. et al. (2001) Observation of covalent intermediates in an enzyme mechanism at atomic resolution. Science 294: 369-374) [1], site-directed mutagenesis was carried out to replace cysteine at position 47 by an arginine (C47N) in EcDERA amino acid sequence or at the equivalent position, C37, in BcDERA (to create C37N) as determined by protein alignment (FIG. 8). These sites were chosen to improve DERA activity because C47 of EcDERA and C47 of BcDERA are located near the active site. Site-directed mutagenesis was carried out using the primers in Table 2 (mutated codon is underlined) and the Phusion Site-Directed Mutagenesis Kit (from Thermo Scientific) according to manufacturer's procedure. As a negative control, an inactive DERA was constructed by mutating the catalytic lysine at position 201 in EcDERA or the equivalent position 181 in BcDERA, by an asparagine (mutation K201N for EcDERA or K181N for BcDERA) using primers in Table 2. All wild-type sequences and the introduction of specific mutations were analysed and validated by sequencing (Eurogentec).

The pentose kinases, ribokinase (rbsK) (SEQ ID NO: 290), xylulokinase (XuK) (SEQ ID NO: 291), and ribulokinase (AraB)(SEQ ID NO: 288) were obtained using genomic DNA from organism of origin and PCR primers in Table 2. Aldehyde dehydrogenase was obtained using genomic DNA of *E. coli* and primers in Table 2.

Protein Expression and Purification

Freshly prepared *Escherichia coli* cells (DE3, New England Biolabs) were used for protein expression. Bacteria cultures were started at OD 600 nm of 0.05 from an overnight pre-culture on rich medium LB (yeast extract 5 g/L, tryptone 10 g/L, NaCl 10 g/L) supplemented with kanamycin at 50 µg/mL. Protein expression was then induced when OD 600 nm reached 0.6/0.8 by addition of 0.5 mM of isopropyl β-D-1-thiogalactopyranoside (IPTG) to the culture medium. Cultures were done at 30° C. and expression was induced for 4 hours. Following expression, *E. coli* cells were harvested by centrifugation and cell pellets were kept at −20° C. until used. To recover and purify the expressed proteins, frozen pellets were resuspended on ice in binding buffer (HEPES 50 mM, pH 7.4, NaCl 300 mM) and sonicated (4 cycles of 30 second on/30 second off, power 30% with a microtip, model FB505 from Fisher Scientific) and then centrifuged at 20.000 g for 15 minutes at 4° C. The supernatant was mixed with His Spintrap TALON (Merck) slurry solution to purify the tagged his-protein according to manufacturer recommendation. All protein purity was checked on SDS-PAGE and showed a major band at the expected size, suggesting a >90% pure protein. Purified protein in elution buffer was exchanged using 10 kDa Amicon Ultra Centrifugal Filter (Merck) for HEPES 50 mM, pH 7, KCl 100 mM, $MgCl_2$ 5 mM for DERA protein enzymatic assays or HEPES 60 mM, pH 7.5, KCl 60 mM, $MgCl_2$ 3 mM for the PGM3 protein enzymatic assays.

In Vitro Pentose Kinase Activity Assay

Figure 9:
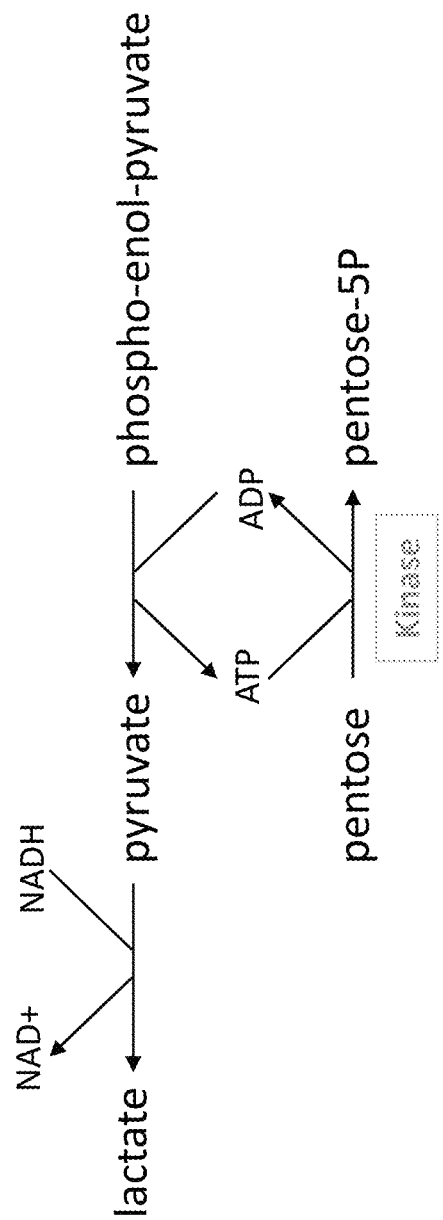
FIG. 9 is a scheme showing the reaction of an assay for measuring pentose kinase activity.
Figure 14:
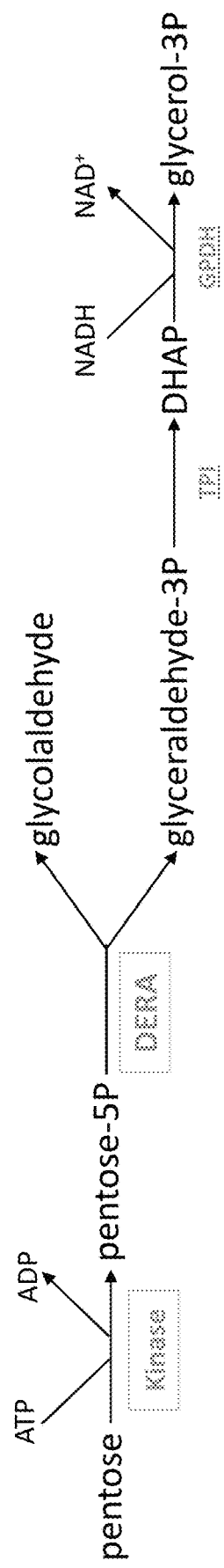
FIG. 14 is a scheme showing the reaction of an assay for measuring recombinant DERA activity from a pentose substrate.
Figure 15:
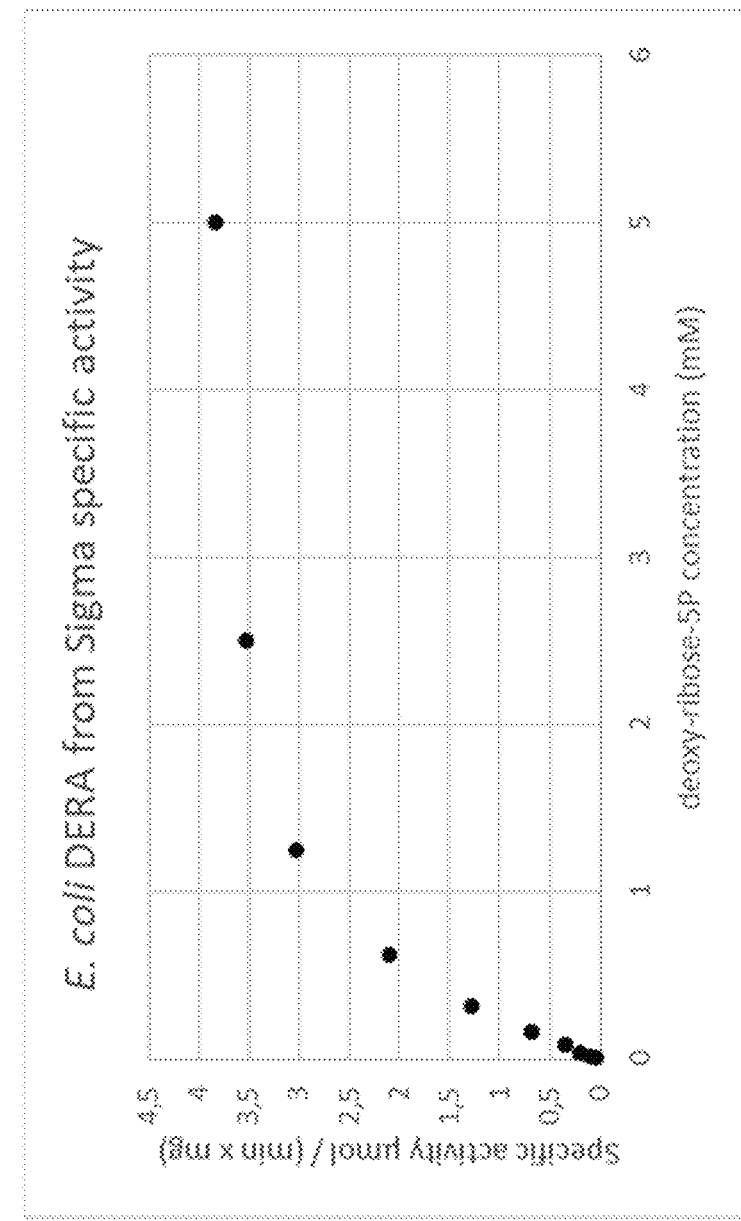
FIG. 15 is a plot of a Michaelis-Menten curve of a commercially available *E. coli*-derived DERA enzyme using the natural substrate, deoxy-ribose-5P. The initial rate is plotted as a function of the substrate concentration.
Figure 16:
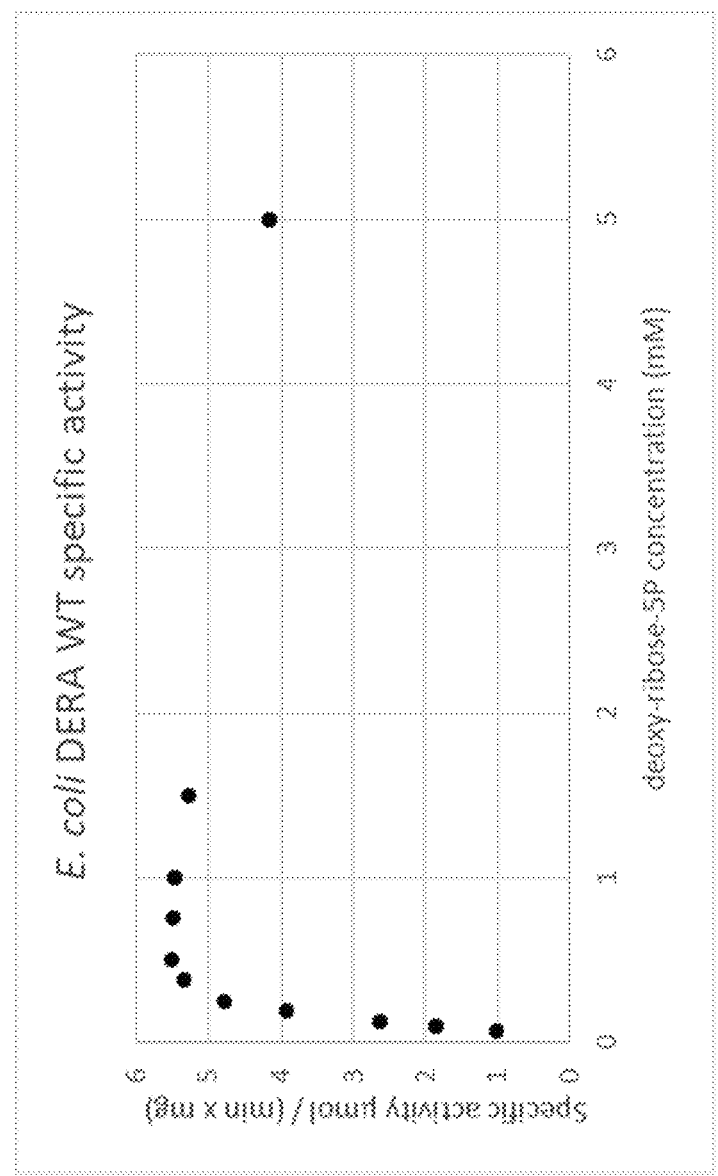
FIG. 16 is a plot of a Michaelis-Menten curve of a recombinant *E. coli*-derived wild-type DERA enzyme using the natural substrate, deoxy-ribose-5P. The initial rate is plotted as a function of the substrate concentration.
Figure 17:
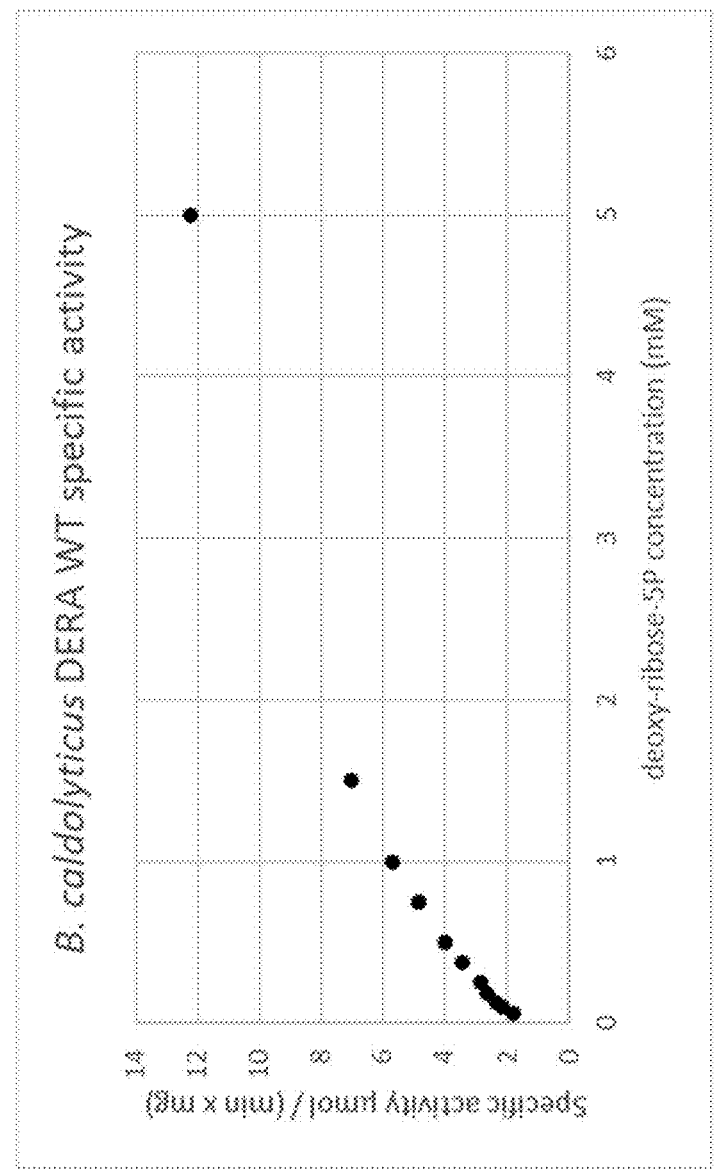
FIG. 17 is a plot of a Michaelis-Menten curve of a recombinant *B. caldolyticus*-derived wild-type DERA enzyme using the natural substrate, deoxy-ribose-5P. The initial rate is plotted as a function of the substrate concentration.
Figure 18:
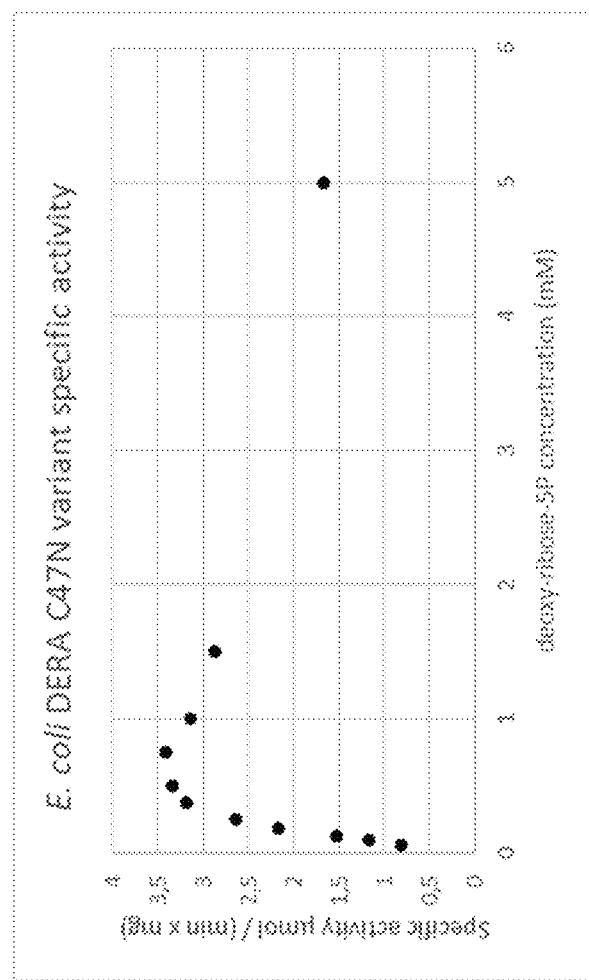
FIG. 18 is a plot of a Michaelis-Menten curve of a recombinant *E. coli*-derived C47N mutated DERA enzyme variant using the natural substrate, deoxy-ribose-5P. The initial rate is plotted as a function of the substrate concentration.

The pentose kinases (ribokinase (rbsK), ribulokinase (AraB), and xylulokinase (XuK)) that were purified as described above were assayed on their respective pentose by enzymatic coupling of ADP produced to NADH oxidation using pyruvate kinase and lactate dehydrogenase (FIG. 9 and FIG. 14). The reaction mixture contained HEPES 50 mM, pH 7, KCl 100 mM, $MgCl_2$ 5 mM, appropriate amount of the sugarkinase, ATP 2 mM, NADH 0.25 mM, range of

TABLE 2

Origin of DNA and Primers Used in Obtaining Target Genes

| Origin and Gene | Mutation | Primer sequence |
|---|---|---|
| *Escherichia coli* (EcDERA) | C47N | C GGC AAT ACC GCC GCT ATC <u>AAT</u> ATC TAT CCT CGC UT ATC C (SEQ ID NO: 257)<br>G GAT AAA GCG AGG ATA GAT <u>ATT</u> GAT AGC GGC GGT ATT GCC G (SEQ ID NO: 258) |
| | K201N | GTA GAA AAA ACC GTT GGT UC <u>AAC</u> CCG GCG GGC (SEQ ID NO: 259)<br>GCC CGC CGG <u>GTT</u> GAA ACC AAC GGT TTT UC TAC (SEQ ID NO: 260) |
| *Bacillus caldolyticus* (BcDERA) | C37N | C TTC GCG GCG GTG <u>AAC</u> GTT AAC CCG ACC TG (SEQ ID NO: 261)<br>CA GGT CGG GTT AAC GTT CAC CGC CGC GAA G (SEQ ID NO: 262) |
| | K181N | GCG GGT GTG <u>AAC</u> GCG AGC GGC GGT G (SEQ ID NO: 263)<br>C ACC GCC GCT CGC <u>GTT</u> CAC ACC CGC (SEQ ID NO: 264) |
| *Escherichia coli* (ribokinase, rbsK) | —<br>— | TAAGCACCATGGCAATGCAAAACGCAG (SEQ ID NO: 265)<br>TGCTTAAAGCTTCCTCTGCCTGTCTAAAAATG (SEQ ID NO: 266) |
| *Thermotoga maritima* (xylulokinase, XuK) | —<br>— | AGGAGATATACCATGGTGGAAGCGGTGATTTTCGACA (SEQ ID NO: 267)<br>GTGCGGCCGCAAGCTTAAGAACCTCTTTGAGAACGTTCAG (SEQ ID NO: 268) |
| *Escherichia coli* (ribulokinase, AraB) | —<br>— | ATGGCGATTGCAATTGGCC (SEQ ID NO: 269)<br>CGAATTCGTTATAGAGTCGCAACGGCCTGG (SEQ ID NO: 270) |
| *Escherichia coli* (aldehyde dehydrogenase, aldA) | —<br>— | CATATGTCAGTACCCGTTCAACATCCTATG (SEQ ID NO: 271)<br>GAATTCGTTAAGACTGTAAATAAACCACCTGGGTCTG (SEQ ID NO: 272) | pentose concentration, phospho-enol-pyruvate 2 mM, commercially available pyruvate kinase (PK) and lactate dehydrogenase (LDH) at 2 U/mL (all products were purchased from Merck).

Figure 10:
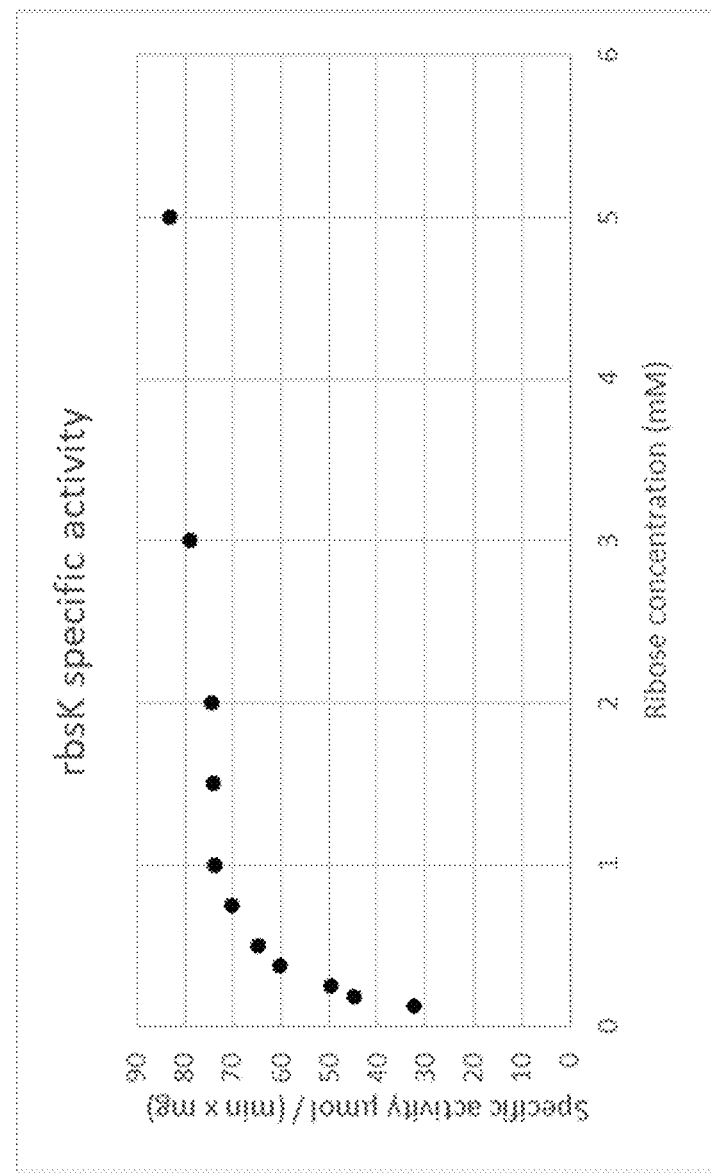
FIG. 10 is a plot of a Michaelis-Menten curve of a recombinant rbsK enzyme on a pentose substrate. The initial rate is plotted as a function of the substrate concentration.
Figure 11:
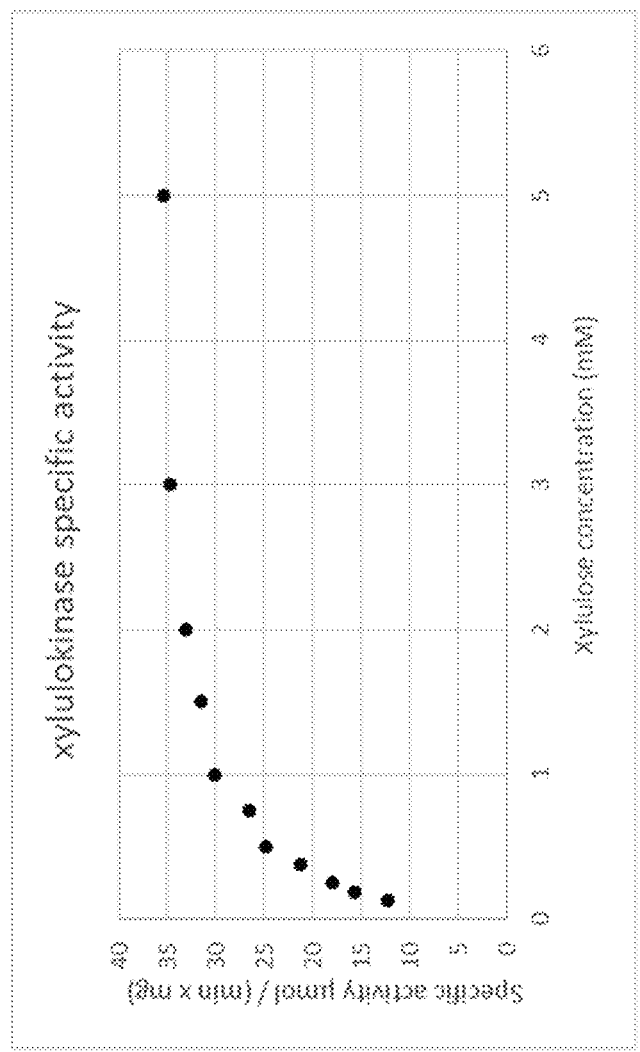
FIG. 11 is a plot of a Michaelis-Menten curve of a recombinant xylulokinase enzyme on a pentose substrate. The initial rate is plotted as a function of the substrate concentration.
Figure 12:
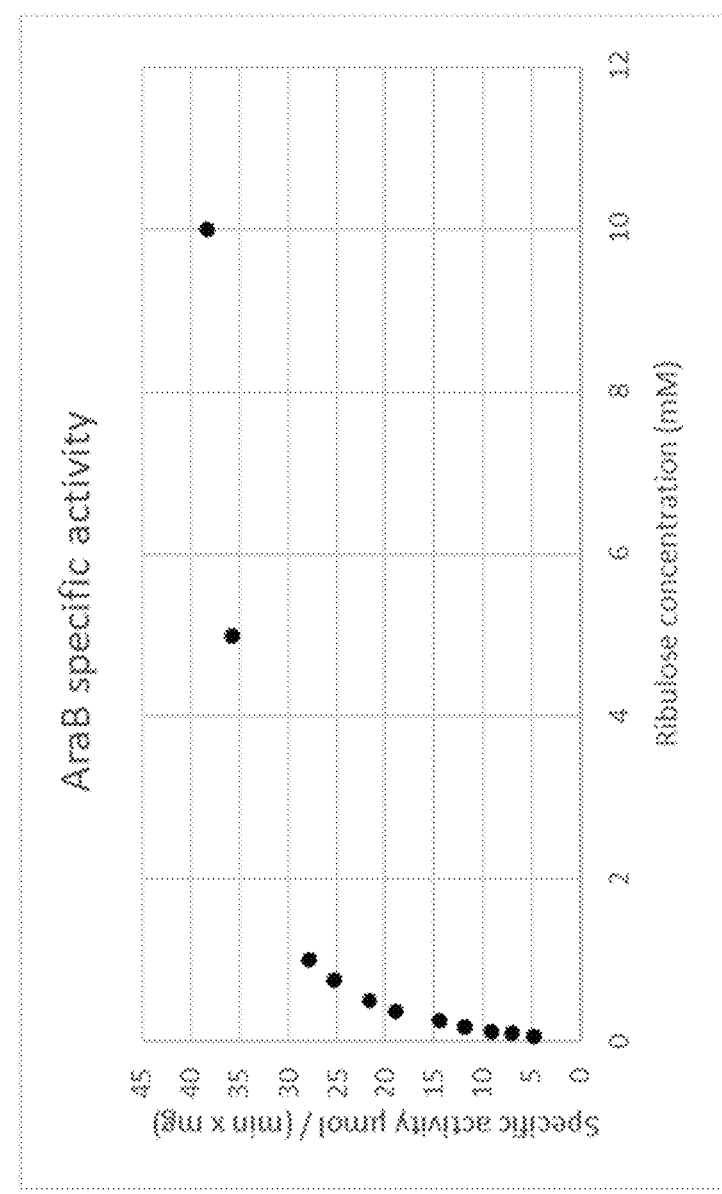
FIG. 12 is a plot of a Michaelis-Menten curve of a recombinant AraB enzyme on a pentose substrate. The initial rate is plotted as a function of the substrate concentration.

Results of the assay showing Michaelis-Menten curves with a pentose substrate for rbsK, xylulokinase (XuK), or AraB are in FIG. 10, FIG. 11, and FIG. 12, respectively. The initial rate is plotted as a function of the substrate concentration. The results indicate that each of the expressed and purified kinases showed kinase activity on their respective pentose substrates.

Figure 19:
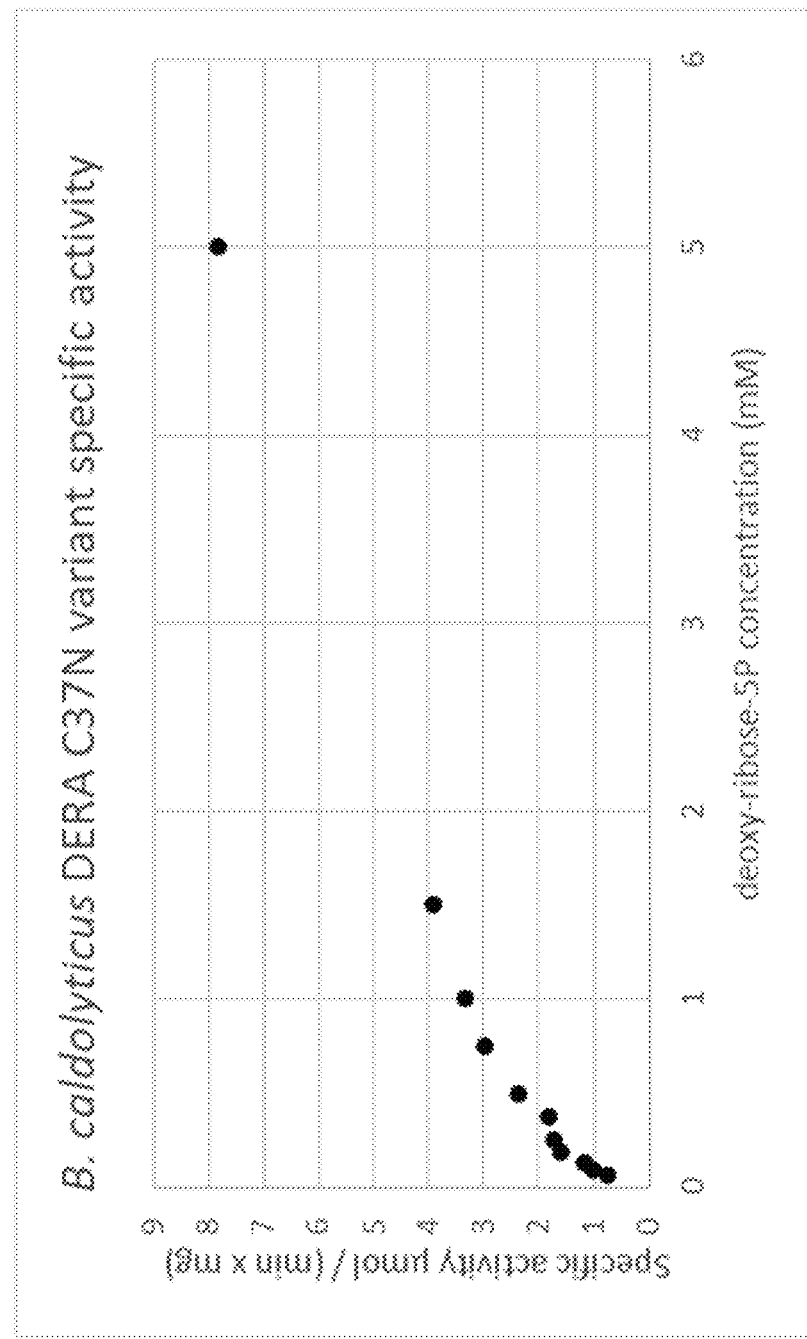
FIG. 19 is a plot of a Michaelis-Menten curve of a recombinant *E. coli*-derived C47N mutated DERA enzyme variant using the natural substrate, deoxy-ribose-5P. The initial rate is plotted as a function of the substrate concentration.
Figure 20:
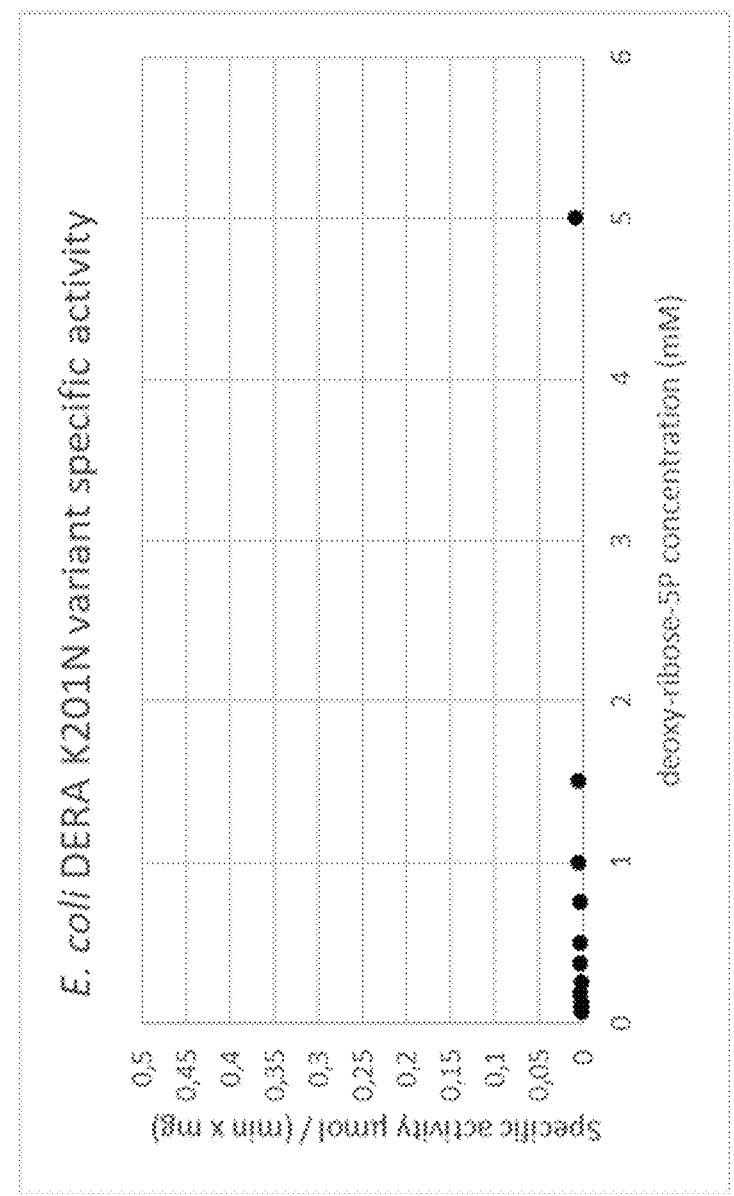
FIG. 20 is a plot of a Michaelis-Menten curve of a recombinant *E. coli*-derived K201N mutated DERA enzyme variant using the natural substrate, deoxy-ribose-5P. The initial rate is plotted as a function of the substrate concentration.

EcDERA enzyme. Likewise, the synthesized BcDERA C47N variant (FIG. 19) retained reduced activity relative to the WT BcDERA enzyme. The negative control EcDERA K201N variant, as expected, showed no activity (FIG. 20).

Table 3 shows results from the in vitro assays for DERA variants demonstrating the impact of the mutations in the DERA protein on enzymatic conversion of ribose-5P, ribulose-5P, and xylulose-5P substrates generated by upstream pentose kinases to glyceraldehyde-3P, and subsequent conversion to DHAP and glycerol-3P. The results suggest that the mutated forms of DERA reduce the rate of glyceraldehyde-3P production and subsequent conversion to DHAP and glycerol-3P.

TABLE 3

Results demonstrating DERA activity on target pentose-5-P intermediates and the impact of DERA mutations on pentose-5P conversion to glycoaldehyde and G3P. DERA specific activity of DERA proteins. Vmax was estimated with an initial substrate concentration of 5 mM.

| Enzyme | Ribose-5P (μmol/(min × mg)) | Ribulose-5P (μmol/(min × mg)) | Xylulose-5P (μmol/(min × mg)) |
|---|---|---|---|
| EcDERA (WT) | 0.0105 ± 0.0138 | 0.0018 ± 0.0018 | 0.0072 ± 0.0055 |
| EcDERA (C47N) | 0.0056 | 0.0005 | 0.0004 ± 0.0015 |
| EcDERA (K201N) | No activity | No activity | No activity |
| BcDERA (WT) | 0.0028 ± 0.0018 | 0.0009 ± 0.0013 | 0.001 ± 0.0013 |
| BcDERA (C37N) | 0.0015 ± 0.0008 | No activity | 0.0018 ± 0.0023 |
| BcDERA (K181N) | No activity | No activity | No activity |

In Vitro DERA Variant Activity Assay

Figure 13:
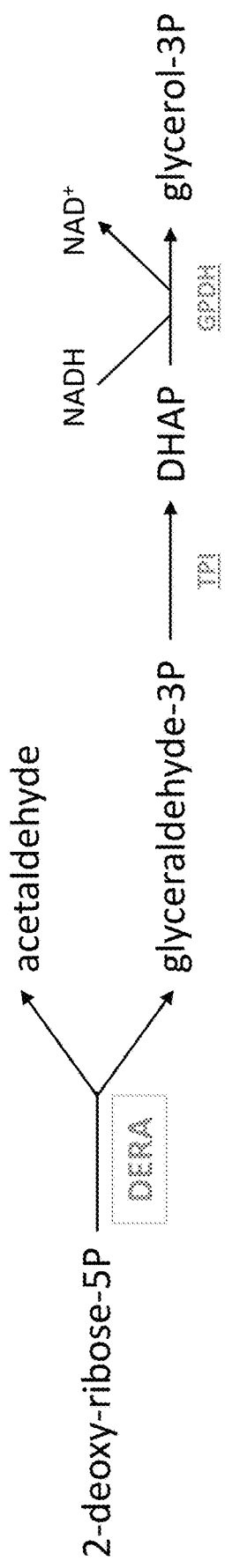
FIG. 13 is a scheme showing the reaction of an assay for measuring recombinant DERA activity using the natural substrate, 2-deoxy-robose-5P.

The in vitro enzymatic assay of DERA variants was carried out by the enzymatic coupling method. FIG. 13 shows the scheme for the DERA assay carried out using the natural substrate of DERA, 2-deoxy-ribose-5P. FIG. 14 shows the scheme for the DERA assay carried out using pentose-5P substrates derived from an upstream kinase reaction. Assays were monitored by measuring the oxidation of NADH at OD 340 nm resulting from the conversion of dihydroxyacetone 3-P (DHAP) to glycerol-3P by glycerol-3-P dehydrogenase (GPDH). Reactions were followed spectrophotometrically at 37° C.

For reactions using the natural substrate, mixtures contained HEPES 50 mM, pH 7.0: KCl 100 mM, MgCl$_2$ 5 mM, NADH 0.25 mM, 2-deoxy-ribose-5P 5 mM, commercially available triose phosphate isomerase (TPI) and glycerol-3-P dehydrogenase (GPDH) at 2 U/mL and appropriate amount of DERA variant protein.

For reactions using kinase-derived pentose-5P substrates, the pentose was either ribose, ribulose, or xylulose. The assays were carried out according to the scheme in FIG. 14 and the mixtures contained HEPES 50 mM, pH 7.0: KCl 100 mM, MgCl$_2$ 5 mM, NADH 0.25 mM, commercially available triose phosphate isomerase (TPI), glycerol-3-P dehydrogenase (GPDH) at 2 U/mL, an appropriate amount of DERA variant protein, 5 mM pentose (ribose, ribulose, or xylulose), an appropriate amount of the specific kinase (i.e. rbsK, AraB, or Xuk), and ATP at 2.5-5 mM.

Figure 21:
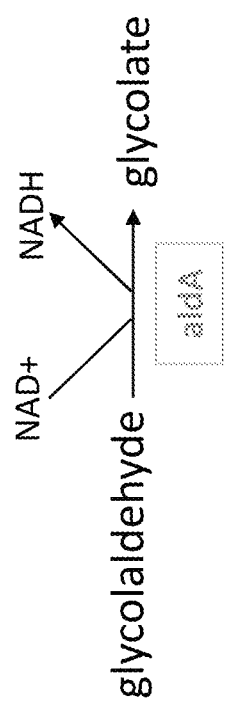
FIG. 21 is a scheme showing the reaction of an assay for measuring aldA activity using a glycoaldehyde substrate.

The in vitro assays for DERA variants demonstrate the impact of the mutations in the DERA protein on enzymatic activity for the natural substrate, 2-deoxy-ribose-5P. Results showing Michaelis-Menten kinetics for each of the DERA variant's activity are shown in FIG. 15, FIG. 16, FIG. 17, FIG. 18, FIG. 19, and FIG. 20. Specific activities for the wild type DERA enzymes from a commercially available source (FIG. 15), synthesized wild type EcDERA enzyme (FIG. 16), and synthesized BcDERA enzyme (FIG. 17) were determined. The synthesized EcDERA C47N variant (FIG. 18) retained reduced activity relative to the wild type In Vitro Enzymatic Assay for aldA AldA protein was tested on its natural substrate, glycolaldehyde, according to the scheme in FIG. 21 by directly monitoring NADH formation. The reaction mixture contained HEPES 50 mM, pH 7, KCl 100 mM, MgCl$_2$ 5 mM, appropriate amount of aldA protein, NAD+2.5 mM, glycolaldehyde 5 mM, (NAD+ was purchased from Merck).

Figure 22:
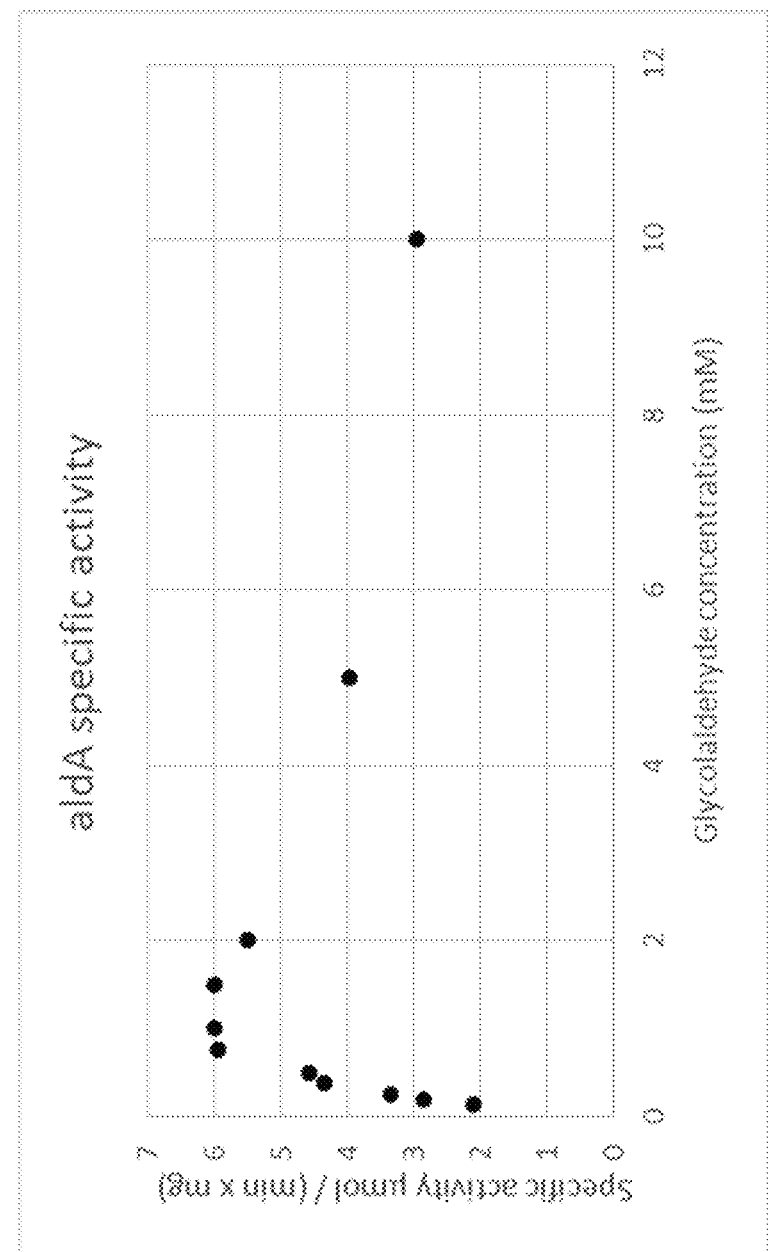
FIG. 22 is a plot of a Michaelis-Menten curve of aldA using glycoaldehyde as a substrate. The initial rate is plotted as a function of the substrate concentration.

The results in FIG. 22 demonstrate that specific activity of the recombinant aldA enzyme retained activity for converting glycoaldehyde to glycolate.

Figure 23:
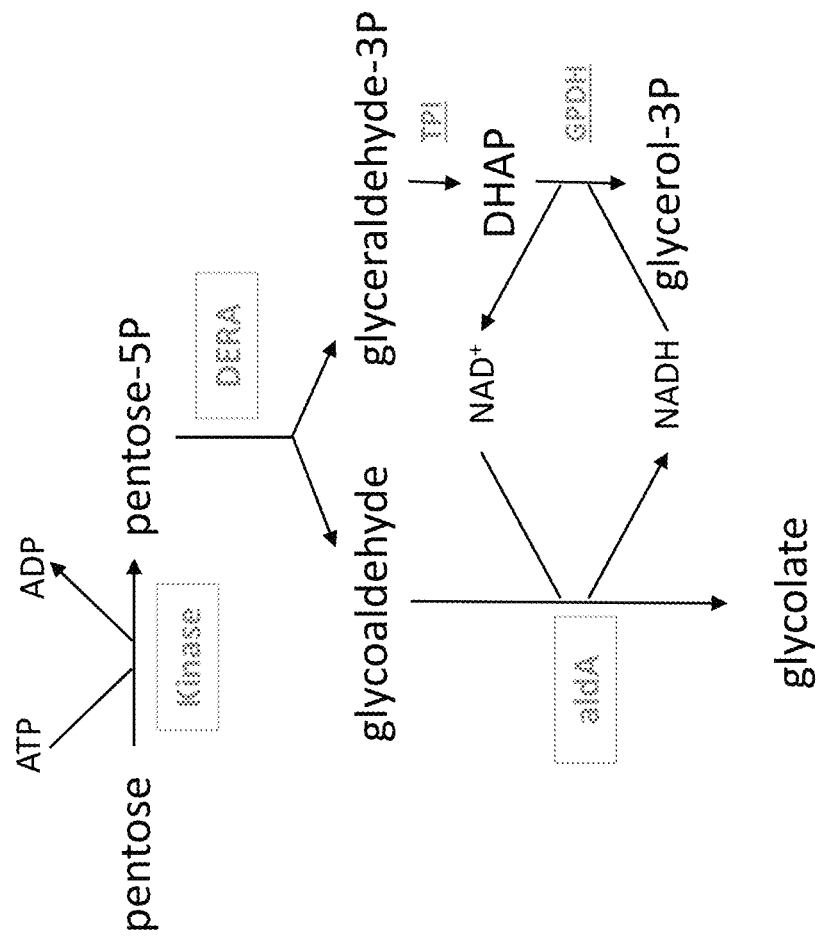
FIG. 23 is a scheme showing the reaction of an assay for measuring glycolate production from a pentose.

In Vitro Validation of GA Production from Pentose and Pentose-5P Intermediates Using DERA This enzymatic assay was designed to validate the in vitro production of glycolic acid from a pentose (ribose, ribulose, or xylulose) and pentose-5P intermediates (ribose-5P, ribulose-5P, or xylulose-5P) by the use and dependency of the DERA enzyme and its variants (FIG. 23). The enzymatic assay was set-up in a reaction mixture of HEPES buffer 50 mM, pH 7.0, KCl 100 mM, MgCl$_2$ 5 mM, NADH 3 mM, ATP*Mg 15 mM, and pentose (ribose, ribulose, or xylulose) 20 mM. The reaction mixture was completed with addition of purified ribokinase (for ribose containing reactions), ribulokinase (for ribulose containing reactions), or xylulokinase (for xylulose containing reactions) each at 0.2 mg/mL, and purified aldehyde dehydrogenase (aldA) at 0.25 mg/mL, a mix of TPI and GPDH at 2 U/mL (TPI/GPDH from Merck) and purified DERA protein at 2.5 mg/mL. The reaction was carried out for 24 hours at 37° C. Following the reaction, the pentose and glycolate concentrations were determined by high-performance liquid chromatography using Thermo Fisher Scientific system (Courtaboeuf, France) equipped with a RI detector, with a UV detector at 205 nm and a Phenomenex column (Rezex H+) at 50° C. using 2.5 mM H$_2$SO$_4$ as mobile phase at 0.5 mL/min. Results from the in vitro validation experiment are given in Table 4, Table 5, and Table 6. For the production of glycolate from xylulose or ribulose according to the scheme in FIG. 23, the EcDERA C47N variant increased production of glycolate compared to EcDERA WT. For the production of glycolate from xylulose, ribulose, or ribose, the BcDERA C37N retained reduced production of glycolate compared to BcDERA WT. As expected, the negative control variants EcDERA K201N and BcDERA K181N did not retain significant capacity to produce glycolate from pentose. Results demonstrate the in-vitro production of glycolic acid from pentose sugars, i.e. from ribose, ribulose and xylulose, by the use of DERA enzyme candidates. Therefore, results also demonstrated DERA activity on target pentose-5P intermediates, like D-ribose-5P, D-ribulose-5P and D-xylulose-5P, validating DERA's ability to convert such pentose-5P intermediates into glycoaldehyde and G3P.

TABLE 4

Results from the in vitro validation assay for GA production from xylulose

| Enzyme | Xylulose (mM) | Glycolate (mM) |
|---|---|---|
| EcDERA WT | 6.27 | 2.54 |
| EcDERA (C47N) | 5.84 | 2.81 |
| EcDERA (K201N) | 1.67 | 0.18 |
| No DERA | 1.97 | 0.19 |
| No kinase | 15.46 | 0.21 |
| — | — | — |
| BcDERA WT | 2.73 | 1.39 |
| BcDERA (C37N) | 2.72 | 0.62 |
| BcDERA (K181N) | 2.58 | 0.09 |
| No DERA | 2.84 | 0.00 |
| No kinase | 20.71 | 0.00 |

TABLE 5

Results from the in vitro validation assay for GA production from ribulose

| Enzyme | Ribulose (mM) | Glycolate (mM) |
|---|---|---|
| EcDERA WT | 3.36 | 6.37 |
| EcDERA (C47N) | 1.78 | 7.87 |
| EcDERA (K201N) | 1.67 | 0.18 |
| No DERA | 1.97 | 0.19 |
| No kinase | 9.06 | 0.29 |
| — | — | — |
| BcDERA WT | 0.00 | 1.70 |
| BcDERA (C37N) | 0.00 | 0.53 |
| BcDERA (K181N) | 0.00 | 0.00 |
| No DERA | 0.00 | 0.00 |
| No kinase | 26.50 | 0.00 |

TABLE 6

Results from the in vitro validation assay for GA production from ribose

| Enzyme | Ribose (mM) | Glycolate (mM) |
|---|---|---|
| BcDERA WT | 0.20 | 0.90 |
| BcDERA (C37N) | 0.10 | 0.40 |
| BcDERA (K181N) | 0.10 | — |

Example 2

In Vivo Assay for Glycolic Acid Production Using DERA in *E. coli*

Figure 24:
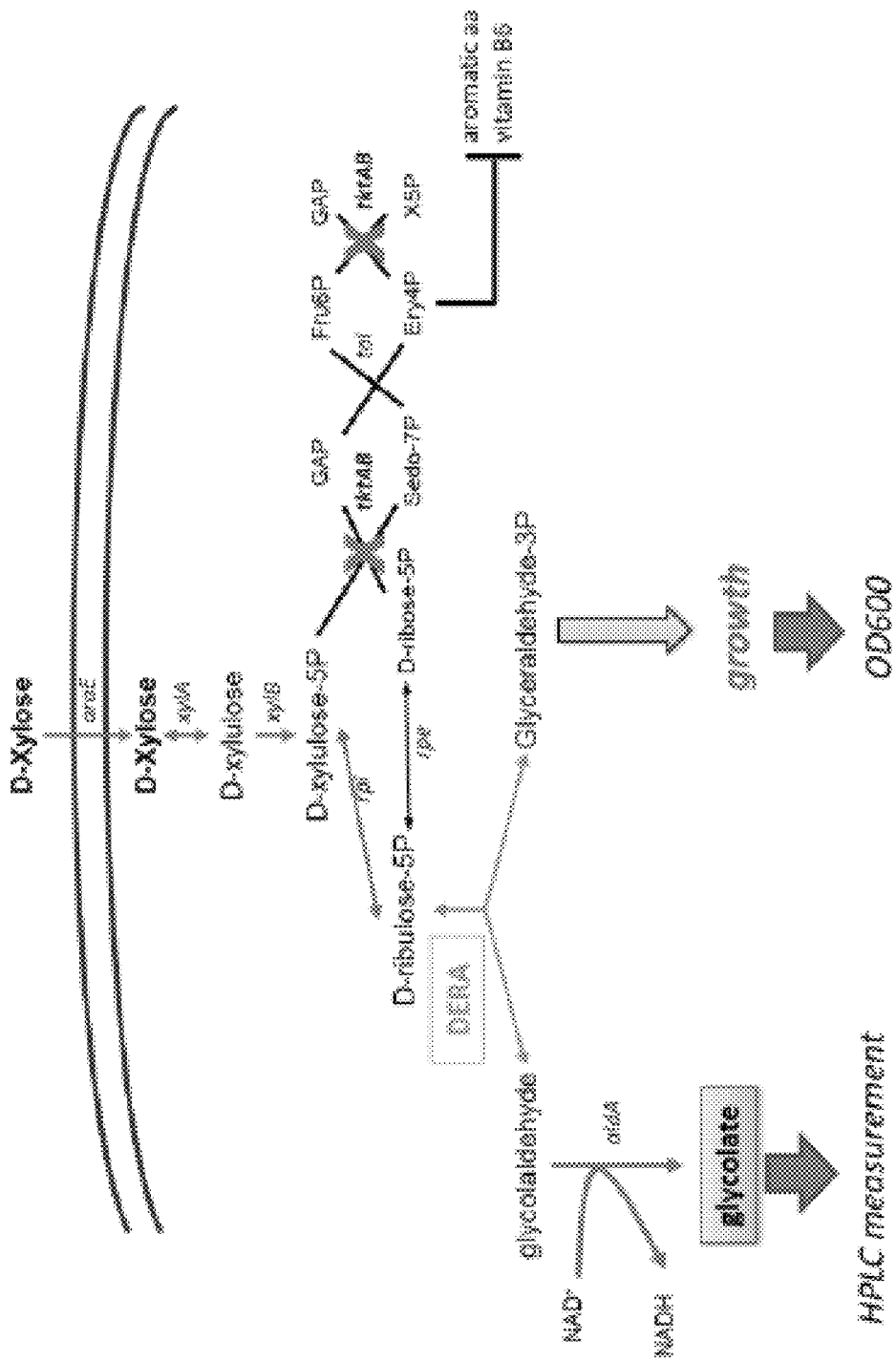
FIG. 24 is a scheme of DERA activity using a MG1655-ΔtktA-ΔtktB strain expressing DERA protein and growing on xylose.

To assess the feasibility of using DERA for glycolic acid (GA) production in vivo, an assay was developed based on the use of a screening *E. coli* strain with the genotype MG1655 ΔtktA-ΔtktB. As described in FIG. 24, such a strain cannot grow on xylose by itself, because of the deletion of transketolase genes tktA (GenBank Gene ID: 947420) and tktB (GenBank Gene ID: 945865). However, a strain expressing an active DERA protein can use pentoses phosphorylated on carbon 5 (pentose-5P) to produce glycolaldehyde and glyceraldehyde-3-phosphate. Glycolaldehyde and glyceraldehyde-3-phosphate can enter the glyoxylate shunt and glycolysis to support strain growth. Consequently, in vivo DERA activity in the screening strain is directly correlated with cell growth.

Deletion of tktA and tktB

Deletion of tktA and tktB were performed sequentially in *Escherichia coli* MG1655 wild-type strain. First, deletion of tktA and tktB was performed by transduction according to standard procedure (Thomason L C, et al. (2007) *E. coli* genome manipulation by P1 transduction. Curr Protoc Mol Biol. Chapter 1: Unit 1 17) using a MG1655 ΔtktA::KanR strain JW5478 and a MG1655 ΔtktB::KanR strain JW2449, both obtained from the Keio single-gene deletion collection (Baba T, et al. (2006) Construction of *E. coli* K-12 in-frame, single-gene knockout mutations: the Keio collection. Mol Sys Biol. 2:2006 0008). Transformants were selected on LB agar supplemented with 100 μg/ml kanamycin and identified by colony PCR and sequencing. Removal of the antibiotic marker was further performed by specific recombination of FTR regions, using Flp recombination, as previously described in the literature (Datsenko K A and Wanner B L (2000) One-step inactivation of chromosomal genes in *Escherichia coli* K-12 using PCR products. Proc Natl Acad Sci USA 97:6640-6645). The resulting strain was named DERA_screening_01: MG1655 ΔtktA-ΔtktB.

Obtention of a DERA C47N Mutant

DERA from *E. coli* (UniProt accession number P0A6L0) was synthesized by GenScript (Hong Kong, China) and cloned in a pET28 vector. Site directed mutagenesis was then used to introduce the point mutation according to the primers described in Table 7, using the Phusion Site-Directed Mutagenesis® Kit (Thermo Scientific™), according to manufacturer's procedure. The EcDERA C47N (SEQ ID NO: 294) mutant was further confirmed by sequencing.

TABLE 7

Oligonucleotides used for site directed mutagenesis. Mutated site is in bold.

| Primer | Primer sequence |
|---|---|
| C47N_FW | CGGCAATACCGCCGCTATCAATATCTATCCTCGCTTTATCC (SEQ ID NO: 273) |
| C47N_RV | GGATAAAGCGAGGATAGATATTGATAGCGGCGGTATTGCCG (SEQ ID NO: 274) |

Plasmid Construction for DERA Expression in the Cell Growth-Based Screening Strain To express DERA in the screening strain, a pZS21 plasmid (Expressys) was first modified by replacing the $P_{LtetO\text{-}1}$ promoter by a J23119 (SEQ ID NO: 293) or a J23101 (SEQ ID NO: 292) constitutive promoter (http://parts.igem.org/Promoters/Catalog/Anderson). Both J23119 and J23101 promoters were obtained as synthetic gene fragments, synthesized by GeneWiz® (Leipzig, Germany). Synthetic promoters were amplified by PCR, using primers detailed in Table 8. They were subsequently cloned into the pZS21 plasmid linearized by enzymatic restriction with AatII and KpnI, by using the NEBuilder® HiFi DNA Assembly Cloning Kit (New England Biolabs) according to the manufacturer's protocol. Construction was confirmed by PCR and sequencing. The resulting plasmids were respectively called pZS2-J23119 and pZS2-J23101.

In order to express a higher number of copies of DERA, the two plasmids were modified with a p15A origin of replication, recovered from a pZA21 plasmid (Expressys). A fragment containing promoter and kanamycin marker from pZS2-J23119 (or pZS2-J23101) was amplified by PCR, along with a fragment containing the p15A origin and multiple cloning site of pZA21, using primers described in Table 8. In-Fusion® HD Cloning Kit (Clontech) was used according to manufacturer's protocol to recombine the DNA fragments into functional plasmids. The resulting plasmids were respectively called pZA2-J23119 and pZA2-J23101.

The EcDERA C47N variant was amplified by PCR using plasmids described in Table 8. It was subsequently cloned into either pZA2-J23119 or pZA2-J23101 linearized by enzymatic restriction with KpnI, by using In-Fusion® HD Cloning Kit (Clontech) according to manufacturer's protocol. Construction was confirmed by PCR and sequencing. The resulting plasmids were called pZA2-J23119-DERA (SEQ ID NO: 295) and pZA2-J23101-DERA (SEQ ID NO: 296), respectively.

Figure 25:
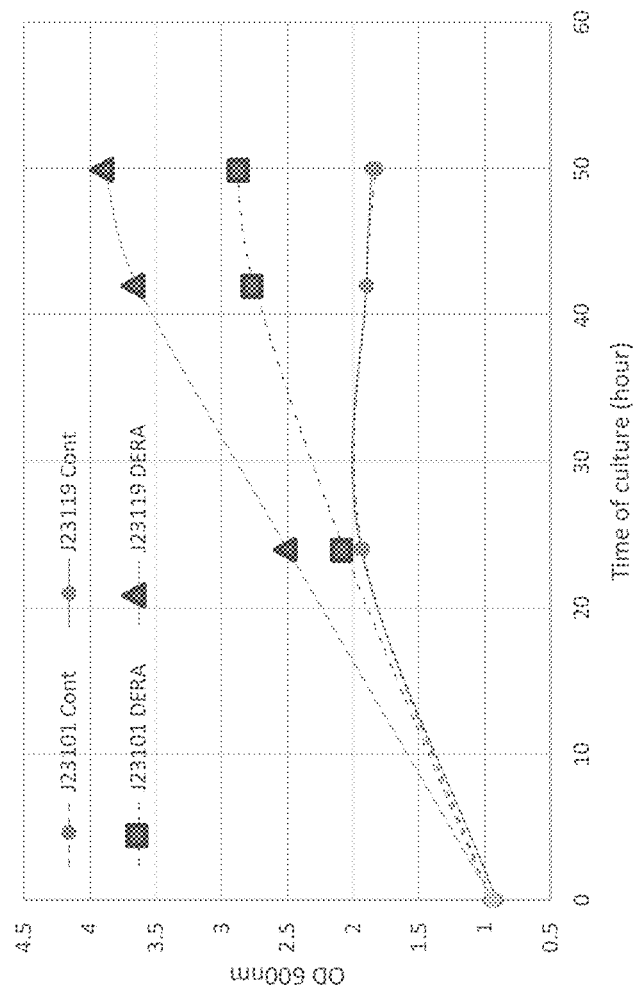
FIG. 25 is a plot of growth curves of *E. coli* strains growing on xylose minimum media.

Results of the growth assay are shown in FIG. 25. The MG1655 ΔtktA-ΔtktB strains containing pZA2-J23119-DERA (J23119 DERA) or pZA2-J23101-DERA (J23101 DERA) both showed enhanced growth compared to their respective controls. J23119 DERA showed enhanced growth compared to J23101 DERA. Taken together, the results suggest that the EcDERA C47N variant expressed in the MG1655 ΔtktA-ΔtktB strain can enable growth when cultured in xylose minimum media.

ENUMERATED EMBODIMENTS

Embodiment 1. A recombinant microorganism comprising one or more biochemical pathways that produces one or more products derived from glyceraldehyde-3-phosphate (G3P) and glycolaldehyde from one or more pentose and/or hexose sugars via a pentose-phosphate intermediate; wherein the one or more biochemical pathway comprises expression of at least one enzyme having pentose-phosphate aldolase activity.

Embodiment 2. The recombinant microorganism of embodiment 1, wherein the pentose-phosphate intermediate is D-ribose-5-phosphate, D-ribulose-5-phosphate or D-xy-

TABLE 8

Oligonucleotides used for the construction of plasmids pZS2-J23119, pZS2-J23101, pZA2-J23119, pZA2-J23101, pZA2-J23119-DERA and pZA2-J23101-DERA.
Binding regions are underlined.

| Primer name | Sequence |
| --- | --- |
| pZS2_J23101_J23119_FW | CGCCCCAGCTGGCAATTCCGACTAAGAAACACAGCTAACACCACG (SEQ ID NO: 275) |
| pZS2_J23101_RV | GTGGTGGTACGCGTACCATGGGATCGGTACCGCTAGCATAATACCTAGGA CTGAGC (SEQ ID NO: 276) |
| pZS2_J23119_RV | GTGGTGGTACGCGTACCATGGGATCGGTACCGCTAGCATTATACCTAGGA CTGAGC (SEQ ID NO: 277) |
| pZA2_MCS_ori_FW | TCGAGGTCGACGGTATCGATAAGCTTGATATCGAA (SEQ ID NO: 278) |
| pZA2_MCS_ori_RV | AGCTCGCTTGGACTCCTGTTGATAGATCC (SEQ ID NO: 279) |
| pZS2_Kan_Promoter_FW | GAGTCCAAGCGAGCTCTCGAACCCCAGAGTCCC (SEQ ID NO: 280) |
| pZS2_Kan_J23101_FW | TACCGTCGACCTCGACGGTACCGCTAGCATAATACCT (SEQ ID NO: 281) |
| pZS2_Kan_J23119_RV | TACCGTCGACCTCGACGGTACCGCTAGCATTATACCT (SEQ ID NO: 282) |
| DERA_assembly_J23101_RV | GGTATTATGCTAGCGTAATAGAAATAATTTTGTTTAACTTTAAGGAGGTTT GGAATGGCAACTGATCTGAAAGCAAGCAGCC (SEQ ID NO: 283) |
| DERA_assembly_J23119_RV | GGTATAATGCTAGCGTAATAGAAATAATTTTGTTTAACTTTAAGGAGGTTT GGAATGGCAACTGATCTGAAAGCAAGCAGCC (SEQ ID NO: 284) |
| DERA_assembly_RV | CCGTCGACCTCGACGTTAGTAGCTGCTGGCGCTCTTACCG (SEQ ID NO: 285) |

In Vivo Assay for Growth of a MG1655 ΔtktA-ΔtktB Using *E. coli* DERA C47N Variant Screening strain DERA_screening_01 (MG1655 ΔtktA-ΔtktB) was transformed by electroporation with either pZA2-J23119-DERA or pZA2-J23101-DERA plasmid, or with empty vector alone using standard procedures (Woodall C. A. *E. coli* Plasmid Vectors. Methods in Molecular Biology™. 2003. vol 235. doi: 10.1385/1-59259-409-3:55). The resulting strains were grown in M9 xylose medium (20 g/L xylose) for 50 hours. Kanamycin was added with a final concentration of 100 µg/mL. Growth was monitored by $OD_{600}$.

lulose-5-phosphate and wherein the enzyme have D-ribose-5-phosphate, D-ribulose-5-phosphate or D-xylulose-5-phosphate aldolase activity.

Embodiment 3. The recombinant microorganism of any preceding embodiment, wherein the recombinant microorganism co-produces monoethylene glycol (MEG) and one or more co-products.

Embodiment 4. The recombinant microorganism of any preceding embodiment wherein the one or more co-products are selected from acetone, isopropanol, propene, L-serine, glycine, monoethanolamine (MEA), ethylenediamine, or a combination thereof.

Embodiment 5. The recombinant microorganism of any preceding embodiment, wherein the one or more product is selected from monoethylene glycol (MEG) and glycolic acid (GA).

Embodiment 6. The recombinant microorganism of any preceding embodiment, wherein the one or more biochemical pathway comprises expression of at least one enzyme having transketolase activity.

Embodiment 7. The recombinant microorganism of any preceding embodiment, wherein the at least one enzyme having transketolase activity is encoded by an amino acid sequence having at least 70% sequence identity, at least 80% sequence identity, or at least 90% sequence identity to tktA or tktB from *E. coli*.

Embodiment 8. The recombinant microorganism of any preceding embodiment, wherein the at least one enzyme having pentose-phosphate aldolase activity is encoded by an amino acid sequence having at least 70% sequence identity, at least 80% sequence identity, or at least 90% sequence identity to deoC from *E. coli*.

Embodiment 9. The recombinant microorganism of any preceding embodiment, wherein the one or more biochemical pathway comprises expression of at least one enzyme having transaldolase activity.

Embodiment 10. The recombinant microorganism of any preceding embodiment, wherein the at least one enzyme having transaldolase activity is encoded by an amino acid sequence having at least 70% sequence identity, at least 80% sequence identity, or at least 90% sequence identity to talA or talB from *E. coli*.

Embodiment 11. The recombinant microorganism of any preceding embodiment, wherein the one or more biochemical pathway comprises expression of at least one enzyme having ribulose-5-phosphate 3-epimerase activity.

Embodiment 12. The recombinant microorganism of any preceding embodiment, wherein the at least one enzyme having ribulose-5-phosphate 3-epimerase activity is encoded by an amino acid sequence having at least 70% sequence identity, at least 80% sequence identity, or at least 90% sequence identity to rpe from *E. coli*.

Embodiment 13. The recombinant microorganism of a any preceding embodiment, wherein the one or more biochemical pathway comprises expression of at least one enzyme having ribose-5-phosphate isomerase activity.

Embodiment 14. The recombinant microorganism of any preceding embodiment, wherein the at least one enzyme having ribose-5-phosphate isomerase activity is encoded by an amino acid sequence having at least 70% sequence identity, at least 80% sequence identity, or at least 90% sequence identity to rpiA or rpiB from *E. coli*.

Embodiment 15. The recombinant microorganism of a any preceding embodiment, wherein the recombinant microorganism further comprises a deleted or diminished activity in one or more endogenous enzymes selected from glyceraldehyde 3-phosphate dehydrogenase, phosphoglycerate kinase and phosphoglycerate mutase.

Embodiment 16. The recombinant microorganism of any preceding embodiment, wherein the glyceraldehyde 3-phosphate dehydrogenase is gapA, the phosphoglycerate kinase is pgk and the phosphoglycerate mutase is gpmA and/or gpmM.

Embodiment 17. The recombinant microorganism of any preceding embodiment, wherein the one or more biochemical pathway comprises expression of at least one enzyme having fructose-6-phosphate phosphoketolase activity.

Embodiment 18. The recombinant microorganism of any preceding embodiment, wherein the at least one enzyme having fructose-6-phosphate phosphoketolase activity is encoded by an amino acid sequence having at least 70% sequence identity, at least 80% sequence identity, or at least 90% sequence identity to an enzyme having fructose-6-phosphate phosphoketolase activity selected from *Bifidobacterium dentium* BDP_1006, *Bifidobacterium lactis* xfp, *Lactobacillus* paraplantarum xpkA and *Bifidobacterium breve* xfp.

Embodiment 19. The recombinant microorganism of any preceding embodiment, wherein the one or more biochemical pathway comprises expression of at least one enzyme having phosphate acetyltransferase activity.

Embodiment 20. The recombinant microorganism of any preceding embodiment, wherein the at least one enzyme having phosphate acetyltransferase activity is encoded by an amino acid sequence having at least 70% sequence identity, at least 80% sequence identity, or at least 90% sequence identity to an enzyme having phosphate acetyltransferase activity selected from *E. coli* pta and *Clostridium acetobutylicum* pta.

Embodiment 21. The recombinant microorganism of any preceding embodiment, wherein the recombinant microorganism further comprises a deleted or diminished activity in an endogenous 6-phosphofructokinase enzyme.

Embodiment 22. The recombinant microorganism of any preceding embodiment, wherein the 6-phosphofructokinase is pfkA and/or pfkB.

Embodiment 23. The recombinant microorganism of a any preceding embodiment, wherein the recombinant microorganism further comprises a deleted or diminished activity in one or more endogenous enzymes selected from glucose 6-phosphate-1-dehydrogenase, 6-phosphogluconolactonase, and 6-phosphogluconate dehydrogenase.

Embodiment 24. The recombinant microorganism of any preceding embodiment, wherein the glucose 6-phosphate-1-dehydrogenase is zwf, the 6-phosphogluconolactonase is pgl, and the 6-phosphogluconate dehydrogenase is gnd.

Embodiment 25. The recombinant microorganism of any preceding embodiment, wherein the one or more pentose and/or hexose sugars comprise D-xylose and the recombinant microorganism further comprises expression of at least one enzyme having xylose isomerase activity and expression of at least one enzyme having xylulose 5-kinase activity.

Embodiment 26. The recombinant microorganism of any preceding embodiment, wherein the at least one enzyme having xylose isomerase activity is encoded by an amino acid sequence having at least 70% sequence identity, at least 80% sequence identity, or at least 90% sequence identity to xylA from *E. coli* or *Pyromyces* sp.

Embodiment 27. The recombinant microorganism of any preceding embodiment, wherein the at least one enzyme having xylulose 5-kinase activity is encoded by an amino acid sequence having at least 70% sequence identity, at least 80% sequence identity, or at least 90% sequence identity to xylB from *E. coli*.

Embodiment 28. The recombinant microorganism of a any preceding embodiment, wherein the one or more pentose and/or hexose sugars comprise D-fructose and the recombinant microorganism further comprises expression of at least one enzyme having fructose 1,6-bisphosphatase activity.

Embodiment 29. The recombinant microorganism of any preceding embodiment, wherein the at least one enzyme having fructose 1,6-bisphosphatase activity is encoded by an amino acid sequence having at least 70% sequence identity, at least 80% sequence identity, or at least 90% sequence identity to fbp from *E. coli*.

Embodiment 30. The recombinant microorganism of any preceding embodiment, wherein the one or more pentose and/or hexose sugars are capable of being converted to one or more intermediate in the non-oxidative pentose phosphate pathway of the recombinant microorganism.

Embodiment 31. The recombinant microorganism of any preceding embodiment, wherein the one or more pentose and/or hexose sugars are comprised of monomers, oligomers, or a combination thereof.

Embodiment 32. The recombinant microorganism of any preceding embodiment, wherein the expression of at least one enzyme having transketolase activity and/or fructose-6-phosphate phosphoketolase activity and the expression of at least one enzyme having pentose-phosphate aldolase activity enables a lossless conversion of one or more pentose and/or hexose sugars to D-ribose-5-phosphate intermediate and the subsequent conversion of D-ribose-5-phosphate to G3P and glycolaldehyde.

Embodiment 33. The recombinant microorganism of an any preceding embodiment, wherein MEG or GA is produced through the conversion of glycolaldehyde in a C2 pathway and through the conversion of G3P in one or more C3 pathways.

Embodiment 34. The recombinant microorganism of any preceding embodiment, wherein MEG is produced by the reduction of glycolaldehyde by an enzyme having glycolaldehyde reductase activity in the C2 pathway.

Embodiment 35. The recombinant microorganism of any preceding embodiment, wherein GA is produced by the oxidation of glycolaldehyde by an enzyme having glycolaldehyde dehydrogenase activity in the C2 pathway.

Embodiment 36. The recombinant microorganism of any preceding embodiment, wherein the at least one enzyme for the production of MEG or GA are selected from at least one enzyme having an activity selected from a 3-phosphoglycerate dehydrogenase activity, a phosphoserine aminotransferase activity, a serine transaminase activity, a 3-phosphohydroxypyruvate phosphatase activity, a phosphoserine phosphatase activity, a hydroxypyruvate decarboxylase activity, a 3-phosphohydroxypyruvate reductase activity, a glycolaldehyde reductase activity, a glycolaldehyde dehydrogenase activity, a serine oxidoreductase (deaminating) or serine-pyruvate aminotransferase activity, a serine decarboxylase activity, an ethanolamine aminotransferase or ethanolamine oxidoreductase (deaminating) activity, a glycerate decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, and a glyoxylate reductase activity.

Embodiment 37. The recombinant microorganism of any preceding embodiment, wherein MEG is produced through the conversion of glycolaldehyde in a C2 pathway and one or more co-product is produced through the conversion of G3P in one or more C3 pathways.

Embodiment 38. The recombinant microorganism of any preceding embodiment, wherein the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, and an acetoacetate decarboxylase activity, and wherein the one or more co-product comprises acetone.

Embodiment 39. The recombinant microorganism of any preceding embodiment, wherein the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, and a secondary alcohol dehydrogenase activity, and wherein the one or more co-product comprises isopropanol.

Embodiment 40. The recombinant microorganism of any preceding embodiment, wherein the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a secondary alcohol dehydrogenase activity, and a dehydratase activity, and wherein the one or more co-product comprises propene.

Embodiment 41. The recombinant microorganism of any preceding embodiment, wherein the at least one enzyme for the production of one or more co-product through the conversion of G3P in one or more C3 pathways are selected from at least one enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a 3-hydroxyisovalerate (3HIV) synthase activity, a hydroxymethylglutaryl-CoA synthase activity, a methylglutaconyl-CoA hydratase activity, a methylcrotonyl-CoA carboxylase activity, a methylcrotonyl-CoA hydratase activity, a 3-hydroxyisovaleryl-CoA thioesterase activity, a 3HIV kinase activity, a 3HIV-3-phosphate decarboxylase activity, and a 3HIV decarboxylase activity, and wherein the one or more co-product comprises isobutene.

Embodiment 42. The recombinant microorganism of any preceding embodiment, wherein the at least one enzyme for the production of one or more co-product through the conversion of G3P in one or more C3 pathways are selected from at least one enzyme having an activity selected from a 3-phosphoglycerate dehydrogenase activity, a phosphoserine aminotransferase activity, a 3-phosphohydroxypyruvate phosphatase activity, a phosphoserine phosphatase activity, a serine oxidoreductase (deaminating) or serine-pyruvate aminotransferase activity, a hydroxypyruvate reductase activity, a 3-phosphoglycerate phosphatase activity, a 2-phosphoglycerate phosphatase activity, a glycerate 3-kinase activity, and a glycerate 2-kinase activity, and wherein the one or more co-product comprises L-serine.

Embodiment 43. The recombinant microorganism of any preceding embodiment, wherein the at least one enzyme for the production of one or more co-product through the conversion of G3P in one or more C3 pathways are selected from at least one enzyme having an activity selected from a serine hydroxymethyltransferase activity, a transferase activity, a formaldehyde dehydrogenase activity, a formate dehydrogenase activity, an activity associated with glycine cleavage system, a 3-phosphoglycerate dehydrogenase activity, a phosphoserine aminotransferase activity, a 3-phosphohydroxypyruvate phosphatase activity, a phosphoserine phosphatase activity, a serine transaminase activity, a hydroxypyruvate decarboxylase activity, a serine oxidoreductase (deaminating) activity, a serine decarboxylase activity, an ethanolamine aminotransferase or ethanolamine oxidoreductase (deaminating) activity, a hydroxypyruvate reductase activity, a 3-phosphoglycerate phosphatase activity, a 2-phosphoglycerate phosphatase activity, a glycerate 3-kinase activity, a glycerate 2-kinase activity, a glycolaldehyde dehydrogenase activity, a glycolate dehydrogenase activity, an alanine-glyoxylate aminotransferase activity, an alanine transaminase activity, an NAD(P)H dependent glutamate dehydrogenase activity, and wherein the one or more co-product comprises glycine.

Embodiment 44. The recombinant microorganism of any preceding embodiment, wherein the activity associated with glycine cleavage system comprise an enzyme or protein selected from a glycine decarboxylase (P protein), an aminomethyltransferase (T protein), a dihydrolipoamide dehydrogenase (L protein), and an H protein.

Embodiment 45. The recombinant microorganism of any preceding embodiment, wherein the at least one enzyme for the production of one or more co-product through the conversion of G3P in one or more C3 pathways are selected from at least one enzyme having an activity selected from a 3-phosphoglycerate dehydrogenase activity, a 3-phosphoserine aminotransferase activity, a 3-phosphohydroxypyruvate phosphatase activity, a phosphoserine phosphatase activity, a transaminase activity, a hydroxypyruvate decarboxylase activity, a serine oxidoreductase (deaminating) or serine-pyruvate aminotransferase activity, a serine decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, an acetaldehyde dehydrogenase activity, and an ethanolamine ammonia lyase activity, and wherein the one or more co-product comprises monoethanolamine (MEA).

Embodiment 46. The recombinant microorganism of any preceding embodiment, wherein the at least one enzyme for the production of one or more co-product through the conversion of G3P in one or more C3 pathways are selected from at least one enzyme having an activity selected from a serine dehydrogenase activity, a 2-aminomalonate semialdehyde decarboxylase activity, an aminoacetaldehyde transaminase activity, a 2-aminomalonate semialdehyde transaminase activity, a 2,3-diaminopropanoate decarboxylase activity, a serine decarboxylase activity, an ethanolamine dehydrogenase activity, a serine hydroxymethyltransferase activity, an aldehyde oxidase activity, an N-acetyl transferase or O-acetyl transferase activity, an N-acetylserine dehydrogenase activity, a transaminase activity, a deacetylase activity, a serine aminase activity, and a 2,3-diaminopropanoate ammonia lyase activity, and wherein the one or more co-product comprises ethylenediamine (EDA).

Embodiment 47. The recombinant microorganism of any preceding embodiment, wherein the recombinant microorganism further comprises one or more modifications to diminish or delete activity in a glycolaldehyde reductase, a glycolaldehyde dehydrogenase, a lactate dehydrogenase, or combination thereof.

Embodiment 48. The recombinant microorganism of any preceding embodiment, wherein at least a portion of the excess NADH produced in the C3 pathway is used as a source of reducing equivalents in the C2 pathway.

Embodiment 49. The recombinant microorganism of any preceding embodiment, wherein at least a portion of the excess NADH produced in the C3 pathway is used to produce ATP.

Embodiment 50. The recombinant microorganism of any preceding embodiment, wherein excess biomass formation is minimized and production of MEG or GA or MEG and one or more co-product is maximized.

Embodiment 51. A method of producing one or more products derived from glyceraldehyde-3-phosphate (G3P) and glycolaldehyde using a recombinant microorganism of any of the preceding Embodiments, wherein the method comprises cultivating the recombinant microorganism in a culture medium containing one or more pentose and/or hexose sugars providing a carbon source until the one or more products derived from glyceraldehyde-3-phosphate (G3P) and glycolaldehyde are produced.

Embodiment 52. The method of any preceding embodiment, wherein the recombinant microorganism co-produces monoethylene glycol (MEG) and one or more co-products.

Embodiment 53. The method of any preceding embodiment, wherein the one or more co-products are selected from acetone, isopropanol, propene, L-serine, glycine, monoethanolamine (MEA), ethylenediamine (EDA), or a combination thereof.

Embodiment 54. The method of any preceding embodiment, wherein the one or more product is selected from monoethylene glycol (MEG) and glycolic acid (GA).

Embodiment 55. A method of producing a recombinant microorganism that produces or accumulates one or more products derived from glyceraldehyde-3-phosphate (G3P) and glycolaldehyde from one or more pentose and/or hexose sugars via a D-ribose-5-phosphate intermediate, comprising:

introducing into or expressing in the recombinant microorganism one or more enzyme for the conversion of the one or more pentose and/or hexose sugars to the D-ribose-5-phosphate intermediate;

introducing into or expressing in the recombinant microorganism one or more enzyme for the conversion of the pentose-phosphate intermediate to G3P and glycolaldehyde;

introducing into or expressing in the recombinant microorganism one or more enzyme for the production of the one or more products from glycolaldehyde in a C2 pathway; and introducing into or expressing in the recombinant microorganism one or more enzymes for the production of the one or more products from G3P in one or more C3 pathways; and culturing the recombinant microorganism in a culture medium containing the one or more pentose and/or hexose sugars to produce or accumulate the one or more products.

Embodiment 56. The method of any preceding embodiment, wherein the recombinant microorganism co-produces monoethylene glycol (MEG) and one or more co-products.

Embodiment 57. The method of any preceding embodiment, wherein the one or more co-products are selected from acetone, isopropanol, propene, L-serine, glycine, monoethanolamine (MEA), ethylenediamine, or a combination thereof.

Embodiment 58. The method of any preceding embodiment, wherein the one or more products is selected from monoethylene glycol (MEG) and glycolic acid (GA).

Embodiment 59. The method of any preceding embodiment, wherein the glycolaldehyde is oxidized to glycolic acid by a glycoladehyde dehydrogenase.

Embodiment 60. The method of any preceding embodiment, wherein the one or more enzyme for the conversion of the one or more pentose and/or hexose sugars to the pentose-phosphate intermediate are selected from one or more enzyme having a transketolase activity, a transaldolase activity, a ribulose-5-phosphate 3-epimerase activity and a ribose-5-phosphate isomerase activity.

Embodiment 61. The method of any preceding embodiment, wherein the method further comprises introducing into the recombinant microorganism one or more modifications to diminish or delete activity in one or more endogenous enzymes selected from glyceraldehyde 3-phosphate dehydrogenase (gapA), phosphoglycerate kinase (pgk) and phosphoglycerate mutase (gpmA and/or gpmM).

Embodiment 62. The method of any preceding embodiment, wherein the one or more enzyme for the conversion of the one or more pentose and/or hexose sugars to the pentose-phosphate intermediate are selected from one or more enzyme having a fructose-6-phosphate phosphoketolase activity, a phosphate acetyltransferase activity, a transketolase activity, a transaldolase activity, a ribulose-5-phosphate 3-epimerase activity and a ribose-5-phosphate isomerase activity.

Embodiment 63. The method of any preceding embodiment, wherein the method further comprises introducing into the recombinant microorganism one or more modifications to diminish or delete activity in an endogenous 6-phosphofructokinase (pfkA and/or pfkB) enzyme.

Embodiment 64. The method of any one of Embodiments 54-62, wherein the one or more enzyme for the conversion of the pentose-phosphate intermediate to G3P and glycolaldehyde is one or more enzyme having a D-ribose-5-phosphate aldolase activity.

Embodiment 65. The method of any preceding embodiment, wherein the method further comprises: introducing into the recombinant microorganism one or more modifications to diminish or delete activity in one or more endogenous enzymes selected from glucose 6-phosphate-1-dehydrogenase, 6-phosphogluconolactonase, and 6-phosphogluconate dehydrogenase.

Embodiment 66. The method of any preceding embodiment, wherein the glucose 6-phosphate-1-dehydrogenase is zwf, the 6-phosphogluconolactonase is pgl, and the 6-phosphogluconate dehydrogenase is gnd.

Embodiment 67. The method of any preceding embodiment, wherein the one or more pentose and/or hexose sugars comprise D-xylose and the method further comprises:

introducing into or expressing in the recombinant microorganism one or more enzyme having xylose isomerase activity for the conversion of D-xylose to D-xylulose; and introducing into or expressing in the recombinant microorganism one or more enzyme having xylulose 5-kinase activity for the conversion of D-xylulose to D-xylulose-5-phosphate.

Embodiment 68. The method of any preceding embodiment, wherein the one or more pentose and/or hexose sugars comprise D-fructose and the recombinant microorganism further comprises: introducing into or expressing in the recombinant microorganism one or more enzyme having fructose 1,6-bisphosphatase activity for the conversion of D-fructose 1,6-bisphosphate to D-fructose 6-phosphate, wherein D-fructose is converted to fructose 1,6-bisphoshate by endogenous enzymes in the recombinant microorganism.

Embodiment 69. The method of any preceding embodiment, wherein the one or more pentose and/or hexose sugars are capable of being converted to one or more intermediate in the non-oxidative pentose phosphate pathway of the recombinant microorganism.

Embodiment 70. The method of any preceding embodiment, wherein the one or more pentose and/or hexose sugars are comprised of monomers, oligomers, or a combination thereof.

Embodiment 71. The method of any preceding embodiment, wherein expression of one or more enzyme having transketolase activity and/or fructose-6-phosphate phosphoketolase activity and expression of one or more enzyme having pentose-phosphate aldolase activity enables a lossless conversion of one or more pentose and/or hexose sugars to pentose-phosphate intermediate and the subsequent conversion of D-ribose-5-phosphate to G3P and glycolaldehyde.

Embodiment 72. The method of any preceding embodiment, wherein MEG or GA is produced through the conversion of glycolaldehyde in a C2 pathway and through the conversion of G3P in one or more C3 pathways.

Embodiment 73. The method of any preceding embodiment, wherein MEG is produced by the reduction of glycolaldehyde by an enzyme having glycolaldehyde reductase activity.

Embodiment 74. The method of any preceding embodiment, wherein GA is produced by the oxidation of glycolaldehyde by an enzyme having glycolaldehyde dehydrogenase activity.

Embodiment 75. The method of any preceding embodiment, wherein the one or more enzyme for the production of MEG or GA are selected from one or more enzyme having an activity selected from a 3-phosphoglycerate dehydrogenase activity, a phosphoserine aminotransferase activity, a serine transaminase activity, a 3-phosphohydroxypyruvate phosphatase activity, a phosphoserine phosphatase activity, a hydroxypyruvate decarboxylase activity, a 3-phosphohydroxypyruvate reductase activity, a glycolaldehyde reductase activity, a glycolaldehyde dehydrogenase activity, a serine oxidoreductase (deaminating) or serine-pyruvate aminotransferase activity, a serine decarboxylase activity, an ethanolamine aminotransferase or ethanolamine oxidoreductase (deaminating) activity, a glycerate decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, and a glyoxylate reductase activity.

Embodiment 76. The method of any preceding embodiment, wherein MEG is produced through the conversion of glycolaldehyde in a C2 pathway and one or more co-product is produced through the conversion of G3P in one or more C3 pathways.

Embodiment 77. The method of any preceding embodiment, wherein the one or more enzyme for the production of the one or more co-product through the conversion of G3P in the one or more C3 pathways are selected from one or more enzyme having an activity selected from a thiolase or acetyl coenzyme A acetyltransferase activity, an acetyl-CoA:acetoacetate transferase or acetate:acetoacetyl-CoA hydrolase activity, and an acetoacetate decarboxylase activity, and wherein the one or more co-product comprises acetone.

Embodiment 78. The method of any preceding embodiment, wherein the one or more enzyme for the production of the one or more co-product through the conversion of G3P in the one or more C3 pathways are selected from one or more enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, and a secondary alcohol dehydrogenase activity, and wherein the one or more co-product comprises isopropanol.

Embodiment 79. The method of any preceding embodiment, wherein one or more enzyme for the production of one or more co-product through the conversion of G3P in one or more C3 pathways are selected from one or more enzyme having an activity selected from a thiolase or acetyl coenzyme A acetyltransferase activity, an acetyl-CoA:acetoacetate transferase or acetate:acetoacetyl-CoA hydrolase activity, an acetoacetate decarboxylase activity, a secondary alcohol dehydrogenase activity, and a dehydratase activity, and wherein the one or more co-product comprises propene.

Embodiment 80. The method of any preceding embodiment, wherein the one or more enzyme for the production of the one or more co-product through the conversion of G3P in the one or more C3 pathways are selected from one or more enzyme having an activity selected from a thiolase or acetyl coenzyme A acetyltransferase activity, an acetyl-CoA: acetoacetate transferase or acetate:acetoacetyl-CoA hydrolase activity, an acetoacetate decarboxylase activity, a 3-hydroxyisovalerate (3HIV) synthase activity, a hydroxymethylglutaryl-CoA synthase activity, a methylglutaconyl-CoA hydratase activity, a methylcrotonyl-CoA carboxylase activity, a methylcrotonyl-CoA hydratase activity, a 3-hydroxyisovaleryl-CoA thioesterase activity, a 3HIV kinase activity, a 3HIV-3-phosphate decarboxylase activity, and a 3HIV decarboxylase activity, and wherein the one or more co-product comprises isobutene.

Embodiment 81. The method of any preceding embodiment, wherein the one or more enzyme for the production of the one or more co-product through the conversion of G3P in the one or more C3 pathways are selected from one or more enzyme having an activity selected from a 3-phosphoglycerate dehydrogenase activity, a phosphoserine aminotransferase activity, a 3-phosphohydroxypyruvate phosphatase activity, a phosphoserine phosphatase activity, a serine oxidoreductase (deaminating) or serine-pyruvate aminotransferase activity, a hydroxypyruvate reductase activity, a 3-phosphoglycerate phosphatase activity, a 2-phosphoglycerate phosphatase activity, a glycerate 3-kinase activity, and a glycerate 2-kinase activity, and wherein the one or more co-product comprises L-serine.

Embodiment 82. The method of any preceding embodiment, wherein the one or more enzyme for the production of the one or more co-product through the conversion of G3P in one or more C3 pathways are selected from one or more enzyme having an activity selected from a serine hydroxymethyltransferase activity, a transferase activity, a formaldehyde dehydrogenase activity, a formate dehydrogenase activity, an activity associated with glycine cleavage system, a 3-phosphoglycerate dehydrogenase activity, a phosphoserine aminotransferase activity, a 3-phosphohydroxypyruvate phosphatase activity, a phosphoserine phosphatase activity, a serine transaminase activity, a hydroxypyruvate decarboxylase activity, a serine oxidoreductase (deaminating) activity, a serine decarboxylase activity, an ethanolamine aminotransferase or ethanolamine oxidoreductase (deaminating) activity, a hydroxypyruvate reductase activity, a 3-phosphoglycerate phosphatase activity, a 2-phosphoglycerate phosphatase activity, a glycerate 3-kinase activity, a glycerate 2-kinase activity, a glycolaldehyde dehydrogenase activity, a glycolate dehydrogenase activity, an alanine-glyoxylate aminotransferase activity, an alanine transaminase activity, an NAD(P)H dependent glutamate dehydrogenase activity, and wherein the one or more co-product comprises glycine.

Embodiment 83. The method of any preceding embodiment, wherein the activity associated with glycine cleavage system comprise an enzyme or protein selected from a glycine decarboxylase (P protein), an aminomethyltransferase (T protein), a dihydrolipoamide dehydrogenase (L protein), and an H protein.

Embodiment 84. The method of any preceding embodiment, wherein the one or more enzyme for the production of the one or more co-product through the conversion of G3P in the one or more C3 pathways are selected from one or more enzyme having an activity selected from a 3-phosphoglycerate dehydrogenase activity, a 3-phosphoserine aminotransferase activity, a 3-phosphohydroxypyruvate phosphatase activity, a phosphoserine phosphatase activity, a transaminase activity, a hydroxypyruvate decarboxylase activity, a serine oxidoreductase (deaminating) or serine-pyruvate aminotransferase activity, a serine decarboxylase activity, a hydroxypyruvate reductase activity, a 3-phosphoglycerate phosphatase activity, a 2-phosphoglycerate phosphatase activity, a glycerate 3-kinase activity, a glycerate 2-kinase activity, an acetaldehyde dehydrogenase activity, and an ethanolamine ammonia lyase activity, and wherein the one or more co-product comprises monoethanolamine (MEA).

Embodiment 85. The method of any preceding embodiment, wherein the one or more enzyme for the production of the one or more co-product through the conversion of G3P in the one or more C3 pathways are selected from one or more enzyme having an activity selected from a serine dehydrogenase activity, a 2-aminomalonate semialdehyde decarboxylase activity, an aminoacetaldehyde transaminase activity, a 2-aminomalonate semialdehyde transaminase activity, a 2,3-diaminopropanoate decarboxylase activity, a serine decarboxylase activity, an ethanolamine dehydrogenase activity, a serine hydroxymethyltransferase activity, an aldehyde oxidase activity, an N-acetyl transferase or O-acetyl transferase activity, an N-acetylserine dehydrogenase activity, a transaminase activity, a deacetylase activity, a serine aminase activity, and a 2,3-diaminopropanoate ammonia lyase activity, and wherein the one or more co-product comprises ethylenediamine (EDA).

Embodiment 86. The method of any preceding embodiment, wherein the method further comprises introducing into the recombinant microorganism one or more modifications to diminish or delete activity in a glycolaldehyde reductase, a glycolaldehyde dehydrogenase, a lactate dehydrogenase, or combination thereof.

Embodiment 87. The method of any preceding embodiment, wherein at least a portion of the excess NADH produced in the C3 pathway is used as a source of reducing equivalents in the C2 pathway.

Embodiment 88. The method of any preceding embodiment, wherein at least a portion of the excess NADH produced in the C3 pathway is used to produce ATP.

Embodiment 89. The method of any preceding embodiment, wherein excess biomass formation is minimized and production of MEG or GA or MEG and one or more co-product is maximized.

SEQUENCE LISTING (300 sequences)

SEQ ID NO: 1 - DNA, 873 bp, Pseudomonas cichorii
gtgaacaaagttggcatgttctacacctactggtcgactgagtggatggtcgactttccggcgactgcgaagcgcattgccgggctcggcttcgacttaatggaaatctcgctcggcgagtttcacaatctttccgacgcgaagaagcgtgagctaaaagccgtggctgatgatctggggctcacggtgatgtgctgtatcggactgaagtctgagtacgactttgcctcgccggacaagagcgttcgtgatgccggcacggaatatgtgaagcgcttgctcgacgactgtcacctcctcggcgcgccggtctttgctggccttacgttctgcgcgtggccccaatctccgccgctggacatgaaggataagcgcccttacgtcgaccgtgcaatcgaaagcgttcgtcgtgttatcaaggtagctgaagactacggcattatttatgcactggaagtggtgaaccgattcgagcagtggctttgcaatgacgccaaggaagcaattgcgtttgccgacgcggttgacagtccggcgtgcaaggtccagctcgacacattccacatgaatatcgaagagacttccttccgcgatgcaatccttgcctgcaagggcaagatgggccatttccatttgggcgaagcgaaccgtctgccgccgggcgagggtcgcctgccgtgggatgaaatattcggggcgctgaaggaaatcggatatgacggcaccatcgttatggaaccgttcatgcgcaagggcggctcggtcagccgcgcggtgggcgtatggcgggatatgtcgaacggtgcgacggacgaagagatggacgagcgcgctcgccgctcgttgcagtttgttcgtgacaagctggcctga

SEQ ID NO: 2 - DNA, 873 bp, Artificial Sequence
  Codon Optimized Pseudomonas cichorii Sequence
atgaacaaagtgggtatgttctatacgtactggtccacggaatggatggttgactttccggcaaccgcgaaacgtattgcgggcctgggcttcgacctgatggaaatttctctgggcgaatttcacaacctgtccgatgcgaaaaagcgtgaactgaaagccgttgccgacgatctgggtctgactgtgatgtgctgtatcggcctgaaatctgaatacgatttcgcgagcccggataaaagcgttcgcgacgccggtactgaatatgtcaaacgtctgctggatgactgtcacctgctgggcgcaccagtgttcgcgggtctgaccttctgtgcgtggccgcagtccccaccgctggacatgaaggataaacgtccgtacgtggaccgtgccatcgaaagcgtgcgccgcgtaatcaaagtcgctgaagattatggcattatttacgctctggaagttgttaaccgtttcgaacagtggctgtgcaacgacgcgaaagaggccattgccttcgctgacgcggtggattctccggcttgcaaagttcagctggacactttccatatgaacatcgaggaaacctccttccgtgacgcgatcctggcttgcaagggtaaaatgggccatttccatctgggcgaagcaaaccgcctgccgccgggcgaaggtcgtctgccgtgggacgaaatttttggcgctctgaaggaaatcggctacgatggcacgattgttatggagccgttcatgcgcaaaggtggctccgtttcccgtgcagttggtgtttggcgtgatatgtctaacggtgccaccgatgaagaaatggacgaacgtgcacgtcgctccctgcaattcgttcgcgataaactggcgtaa

SEQ ID NO: 3 - protein, 290 aa, Pseudomonas cichorii
MNKVGMFYTYWSTEWMVDFPATAKRIAGLGFDLMEISLGEFHNLSDAKKRELKAVADDLGLTVMCCIGLKSEYDFASPDKSVRDAGTEYVKRLLDDCHLLGAPVFAGLTFCAWPQSPPLDMKDKRPYVDRAIESVRRVIKVAEDYGIIYALEVVNRFEQWLCNDAKEAIAFADAVDSPACKVQLDTFHMNIEETSFRDAILACKGKMGHFHLGEANRLPPGEGRLPWDEIFGALKEIGYDGTIVMEPFMRKGGSVSRAVGVWRDMSNGATDEEMDERARRSLQFVRDKLA

SEQ ID NO: 4 - DNA, 888 bp, Rhodobacter sphaeroides
gtgaaaaatcctgtcggcatcatctcgatgcagttcatccggcccttcacctcggagtcgctgcatttcctgaagaagtcccgggccctgggcttcgatttcatcgagcttctcgtgcccgagcccgaagacgggctcgacgcggccgaggtgcggcgcatctgcgagggcgaggggctgggcctcgttctggccgcgcgcgtgaacctccagcgctcgatcgcgagcgaggaggccgcggcgcgggccggcgggcgcgactatctgaaatactgcatcgaggccgccgaggcgctcggcgcgaccatcgtcggcggcccgctctatggcgagccgctggtcttcgccggccgcccgcccttcccctggacggccgagcagatcgccacccgcgccgcccgcaccgtcgaggggctggccgaagtggccccgctcgccgcgagcgcgggcaaggtcttcgggctcgagccgctgaaccgcttcgagaccgacatcgtgaacacgaccgcacaggccatcgaggtggtggatgcggtgggctcgcccggtctcggcgtcatgctcgacacgttccacatgaacatggaggaacgctcgatccccgatgcgatccgcgccacaggcgcgcgcctcgtccattttcaggccaacgagaaccaccgcggcttccccggcaccggcaccatggactggacggccatcgcgcgggcgctggggcaggcgggctacgcgggtccggtctcgctcgagcctttccggcgcgacgacgagcgcgtggcgctgcccatcgcccactggcgcgccccgcacgaggacgaggacgagaagctgcgcgcggggctgggtctcatccgctccgcgatcaccctggcggaggtgacccactga

SEQ ID NO: 5 - protein, 295 aa, Rhodobacter sphaeroides
MKNPVGIISMQFIRPFTSESLHFLKKSRALGFDFIELLVPEPEDGLDAAEVRRICEGEGLGLVLAARVNLQRSIASEEAAARAGGRDYLKYCIEAAEALGATIVGGPLYGEPLVFAGRPPFPWTAEQIATRAARTVEGLAEVAPLAASAGKVFGLEPLNRFETDIVNTTAQAIEVVDAVGSPGLGVMLDTFHMNMEERSIPDAIRATGARLVHFQANENHRGFPGTGTMDWTAIARALGQAGYAGPVSLEPFRRDDERVALPIAHWRAPHEDEDEKLRAGLGLIRSAITLAEVTH

SEQ ID NO: 6 - DNA, 1422 bp, Escherichia coli
atgatgaaacaagaagttatcctggtactcgactgtggcgcgaccaatgtcagggccatcgcggttaatcggcagggcaaaattgttgcccgcgcctcaacgcctaatgccagcgatatcgcgatggaaaacaacacctggcaccagtggtctttagacgccattttgcaacgctttgctgattgctgtcggcaaatcaatagtgaactgactgaatgccacatccgcggtatcgccgtcaccacctttggtgtggatggcgctctggtagataagcaaggcaatctgctctatccgattattagctggaaatgtccgcgaacagcagcggttatggacaatattgaacggttaatctccgcacagcggttgcaggctatttctggcgtcggagcctttagtttcaatacgttatataagttggtgtggttgaaagaaaatcatccacaactgctggaacgcgcgcacgcctggctctttatttcgtcgctgattaaccaccgtttaaccggcgaattcactactgatatcacgatggccggaaccagccagatgctggatatccagcaacgcgatttcagtccgcaaattttacaagccaccggtattccacgccgactcttccctcgtctggtggaagcgggtgaacagattggtacgctacagaacagcgccgcagcaatgctcggcttacccgttggcataccggtgatttccgcaggtcacgatacccagttcgccctttttggcgctggtgctgaacaaaatgaacccgtgctctcttccggtacatgggaaattttaatggttcgcagcgcccaggttgatacttcgctgttaagtcagtacgccggttccacctgcgaactggatagccaggcagggttgtataacccaggtatgcaatggctggcatccggcgtgctggaatgggtgagaaaactgttctggacggctgaaacaccctggcaaatgttgattgaagaagctcgtctgatcgcgcctggcgcggatggcgtaaaaatgcagtgtgatttattgtcgtgtcagaacgctggctggcaaggagtgacgcttaataccacgcgggggcatttctatcgcgcggcgctggaagggttaactgcgcaattacagcgcaatctacagatgctggaaaaaatcgggcactttaaggcctctgaattattgttagtcggtggaggaagtcgcaacacattgtggaatcagattaaagccaatatgcttgatattccggtaaaagttctcgacgacgccgaaacgaccgtcgcaggagctgcgctgttcggttggtatggcgtaggggaatttaacagcccggaagaagcccgcgcacagattcattatcagtaccgttatttctacccgcaaactgaacctgaatttatagaggaagtgtga

SEQ ID NO: 7 - DNA, 1422 bp, Artificial Sequence; identical to SEQ ID NO: 6
  Codon Optimized E. coli Sequence

SEQ ID NO: 8 - protein, 473 aa, Escherichia coli
MMKQEVILVLDCGATNVRAIAVNRQGKIVARASTPNASDIAMENNTWHQWSLDAILQRFADCCRQINSELTECHIRGIAVTTFGVDGALVDKQGNLLYPIISWKCPRTAAVMDNIERLISAQRLQAISGVGAFSFNTLYKLVWLKENHPQLLERAHAWLFISSLINHRLTGEFTTDITMAGTSQMLDIQQRDFSPQILQATGIPRRLFPRLVEAGEQIGTLQNSAAAMLGLPVGIPVISAGHDTQFALFGAGAEQNEPVLSSGTWEILMVRSAQVDTSLLSQYAGSTCELDSQAGLYNPGMQWLASGVLEWVRKLFWTAETPWQMLIEEARLIAPGADGVKMQCDLLSCQNAGWQGVTLNTTRGHFYRAALEGLTAQLQRNLQMLEKIGHFKASELLLVGGGSRNTLWNQIKANMLDIPVKVLDDAETTVAGAALFGWYGVGEFNSPEEARAQIHYQYRYFYPQTEPEFIEEV

SEQ ID NO: 9 - DNA, 648 bp, Escherichia coli
atggaacgaaataaacttgctcgtcagattattgacacttgcctggaaatgacccgcctgggactgaaccaggggacagcggggaacgtcagtgtacgttatcaggatgggatgctgattacgcctacaggcattccatatgaaaaactgacggagtcgcatattgtctttattgatggcaacggtaaacatgaggaaggaaagctcccctcaagcgaatggcgtttccatatggcagcctatcaaagcagaccggatgccaacgcggttgttcacaatcatgccgttcattgcacggcagtttccattcttaaccgatcgatccccgctattcactacatgattgcggcggctggcggtaattctattccttgcgcgccttatgcgacctttggaacacgcgaactttctgaacatgttgcgctggctctcaaaaatcgtaaggcaactttgttacaacatcatgggcttatcgcttgtgaggtgaatctggaaaaagcgttatggctggcgcatgaagttgaagtgctggcgcaactttacctgacgaccctggcgattacggacccggtgccagtgctgagcgatgaagagattgccgtagtgctggagaaattcaaaacctatgggttacgaattgaagagtaa

SEQ ID NO: 10 - DNA, 648 bp, Escherichia coli; identical to SEQ ID NO: 9

SEQ ID NO: 11 - protein, 215 aa, Escherichia coli
MERNKLARQIIDTCLEMTRLGLNQGTAGNVSVRYQDGMLITPTGIPYEKLTESHIVFIDGNGKHEEGKLPSSEWRFHMAAYQSRPDANAVVHNHAVHCTAVSILNRSIPAIHYMIAAAGGNSIPCAPYATFGTRELSEHVALALKNRKATLLQHHGLIACEVNLEKALWLAHEVEVLAQLYLTTLAITDPVPVLSDEEIAVVLEKFKTYGLRIEE

SEQ ID NO: 12 - DNA, 1104 bp, Escherichia coli
atggaccgcattattcaatcaccgggtaaatacatccagggcgctgatgtgattaatcgtctgggcgaatacctgaagccgctggcagaacgctggttagtggtgggtgacaaatttgttttaggttttgctcaatccactgtcgagaaaagctttaaagatgctggactggtagtagaaattgcgccgtttggcggtgaatgttcgcaaaatgagatcgaccgtctgcgtggcatcgcggagactgcgcagtgtggcgcaattctcggtatcggtggcggaaaaaccctcgatactgccaaagcactggcacatttcatgggtgttccggtagcgatcgcaccgactatcgcctctaccgatgcaccgtgcagcgcattgtctgttatctacaccgatgagggtgagtttgaccgctatctgctgttgccaaataacccgaatatggtcattgtcgacaccaaaatcgtcgctggcgcacctgcacgtctgttagcggcgggtatcggcgatgcgctggcaacctggtttgaagcgcgtgcctgctctcgtagcggcgcgaccaccatggcgggcggcaagtgcacccaggctgcgctggcactggctgaactgtgctacaacaccctgctggaagaaggcgaaaaagcgatgcttgctgccgaacagcatgtagtgactccggcgctggagcgcgtgattgaagcgaacacctatttgagcggtgttggttttgaaagtggtggtctggctgcggcgcacgcagtgcataacggcctgaccgctatcccggacgcgcatcactattatcacggtgaaaaagtggcattcggtacgctgacgcagctggttctggaaaatgcgccggtggaggaaatcgaaaccgtagctgcccttagccatgcggtaggtttgccaataactctcgctcaactggatattaaagaagatgtcccggcgaaaatgcgaattgtggcagaagcggcatgtgcagaaggtgaaaccattcacaacatgcctggcggcgcgacgccagatcaggtttacgccgctctgctggtagccgaccagtacggtcagcgtttcctgcaagagtgggaataa

SEQ ID NO: 13 - protein, 367 aa, Escherichia coli
MDRIIQSPGKYIQGADVINRLGEYLKPLAERWLVVGDKFVLGFAQSTVEKSFKDAGLVVEIAPFGGECSQNEIDRLRGIAETAQCGAILGIGGGKTLDTAKALAHFMGVPVAIAPTIASTDAPCSALSVIYTDEGEFDRYLLLPNNPNMVIVDTKIVAGAPARLLAAGIGDALATWFEARACSRSGATTMAGGKCTQAALALAELCYNTLLEEGEKAMLAAEQHVVTPALERVIEANTYLSGVGFESGGLAAAHAVHNGLTAIPDAHHYYHGEKVAFGTLTQLVLENAPVEEIETVAALSHAVGLPITLAQLDIKEDVPAKMRIVAEAACAEGETIHNMPGGATPDQVYAALLVADQYGQRFLQEWE

SEQ ID NO: 14 - DNA, 1029 bp, Saccharomyces cerevisiae
atgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataa

SEQ ID NO: 15 - protein, 342 aa, Saccharomyces cerevisiae
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 16 - DNA, 984 bp, Saccharomyces cerevisiae
atgtcttcactggttactcttaataacggtctgaaaatgcccctagtcggcttagggtgctggaaaattgacaaaaaagtctgtgcgaatcaaatttatgaagctatcaaattaggctaccgtttattcgatggtgcttgcgactacggcaacgaaaaggaagttggtgaaggtatcaggaaagccatctccgaaggtcttgtttctagaaaggatatatttgttgtttcaaagttatggaacaattttcaccatcctgatcatgtaaaattagctttaaagaagaccttaagcgatatgggacttgattatttagacctgtattatattcacttcccaatcgccttcaaatatgttccatttgaagagaaataccctccaggattctatacgggcgcagatgacgagaagaaaggtcacatcaccgaagcacatgtaccaatcatagatacgtaccgggctctggaagaatgtgttgatgaaggcttgattaagtctattggtgtttccaactttcagggaagcttgattcaagatttattacgtggttgtagaatcaagcccgtggctttgcaaattgaacaccatccttatttgactcaagaacacctagttgagttttgtaaattacacgatatccaagtagttgcttactcctccttcggtcctcaatcattcattgagatggacttacagttggcaaaaaccacgccaactctgttcgagaatgatgtaatcaagaaggtctcacaaaaccatccaggcagtaccacttcccaagtattgcttagatgggcaactcagagaggcattgccgtcattccaaaatcttccaagaaggaaaggttacttggcaacctagaaatcgaaaaaaagttcactttaacggagcaagaattgaaggatatttctgcactaaatgccaacatcagatttaatgatccatggacctggttggatggtaaattccccacttttgcctga

SEQ ID NO: 17 - protein, 327 aa, Saccharomyces cerevisiae
MSSLVTLNNGLKMPLVGLGCWKIDKKVCANQIYEAIKLGYRLFDGACDYGNEKEVGEGIRKAISEGLVSRKDIFVVSKLWNNFHHPDHVKLALKKTLSDMGLDYLDLYYIHFPIAFKYVPFEEKYPPGFYTGADDEKKGHITEAHVPIIDTYRALEECVDEGLIKSIGVSNFQGSLIQDLLRGCRIKPVALQIEHHPYLTQEHLVEFCKLHDIQVVAYSSFGPQSFIEMDLQLAKTTPTLFENDVIKKVSQNHPGSTTSQVLLRWATQRGIAVIPKSSKKERLLGNLEIEKKFTLTEQELKDISALNANIRFNDPWTWLDGKFPTFA

SEQ ID NO: 18 - DNA, 1164 bp, Escherichia coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcagaagcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaa

SEQ ID NO: 19 - DNA, 1167 bp, Artificial Sequence
  Codon Optimized E. coli Sequence
atgaacaattttaatttgcatactccaactagaatattatttggaaaaggtgcaattgcaggtttaagggaacaaataccacatgatgcaagggtattaatcacatacggtggtggttctgtcaagaaaactggtgtattggatcaagtattggatgctttaaagggtatggatgtcttggaatttggaggaatcgaaccaaaccctgcttacgagactttaatgaatgctgtcaaattggtcagagaacaaaaggtaacattcttattggctgttggaggtggatcagtattagatggtacaaagttcattgctgctgcagcaaattatccagaaaacattgatccatggcatatattgcaaactggtggtaaggaaataaagtcagctatcccaatgggatgtgttttgacattgcctgcaacaggatcagaatcaaacgctgaagcagtcatctcaagaaagactacaggtgacaaacaggcattccattctgcccatgtccaacctgtatttgctgttttagaccctgtatacacttacacattaccaccaaggcaagtcgcaaatggagttgtcgatgcctttgttcacactgtagaacagtacgtcaccaaaccagtcgatgcaaagatccaggacaggtttgcagaaggtattttattgacattaatcgaagatggaccaaaagcattgaaagagccagagaactatgacgttagggcaaatgttatgtgggctgctacccaggcattgaacggtttaattggtgcaggagttccacaagattgggctacacacatgttgggtcacgagttgaccgccatgcacggtttggaccatgcacagactttagccattgttttgcctgccttatggaacgagaaaagagatactaagagggctaagttattacaatacgctgaaagggtttggaatatcaccgagggatctgatgatgaaaggattgatgccgctattgcagccactagaaacttctttgaacaattaggtgttccaactcacttgtctgactatggtttagatggatcatctattccagctttgttgaagaaattggaagagcacggtatgacccagttgggtgagaatcatgatataaccttagatgtatctaggagaatctacgaggctgctagataatga

SEQ ID NO: 20 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAEAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 21 - DNA, 1164 bp, Escherichia coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgttggatgtcagccgccgtatatacgaagccgcccgctaa

SEQ ID NO: 22 - DNA, 1164 bp, Artificial Sequence; identical to SEQ ID NO: 21
  Codon Optimized E. coli Sequence

SEQ ID NO: 23 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 24 - DNA, 981 bp, Escherichia coli
atgaaaaagatacctttaggcacaacggatattacgctttcgcgaatggggttggggacatgggccattggcggcggtcctgcatggaatggcgatctcgatcggcaaatatgtattgatacgattcttgaagcccatcgttgtggcattaatctgattgatactgcgccaggatataactttggcaatagtgaagttatcgtcggtcaggcgttaaaaaaactgccccgtgaacaggttgtagtagaaaccaaatgcggcattgtctgggaacgaaaaggaagtttattcaacaaagttggcgatcggcagttgtataaaaacctttccccggaatctatccgcgaagaggtagcagcgagcttgcaacgtctgggtattgattacatcgatatctacatgacgcactggcagtcggtgccgccattttttacgccgatcgctgaaactgtcgcagtgcttaatgagttaaagtctgaagggaaaattcgcgctataggcgctgctaacgtcgatgctgaccatatccgcgagtatctgcaatatggtgaactggatattattcaggcgaaatacagtatcctcgaccgggcaatggaaaacgaactgctgccactatgtcgtgataatggcattgtggttcaggtttattccccgctagagcagggattgttgaccggcaccatcactcgtgattacgttccgggcggcgctcgggcaaataaagtctggttccagcgtgaaaacatgctgaaagtgattgatatgcttgaacagtggcagccactttgtgctcgttatcagtgcacaattcccactctggcactggcgtggatattaaaacagagtgatttaatctccattcttagtggggctactgcaccggaacaggtacgcgaaaatgtcgcggcactgaatatcaacttatcggatgcagacgcaacattgatgagggaaatggcagaggccctggagcgttaa

SEQ ID NO: 25 - protein, 326 aa, Escherichia coli
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVAASLQRLGIDYIDIYMTHWQSVPPFFTPIAETVAVLNELKSEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 26 - DNA, 1149 bp, Escherichia coli
atggctaacagaatgattctgaacgaaacggcatggtttggtcggggtgctgttggggctttaaccgatgaggtgaaacgccgtggttatcagaaggcgctgatcgtcaccgataaaacgctggtgcaatgcggcgtggtggcgaaagtgaccgataagatggatgctgcagggctggcatgggcgatttacgacggcgtagtgcccaacccaacaattactgtcgtcaaagaagggctcggtgtattccagaatagcggcgcggattacctgatcgctattggtggtggttctccacaggatacttgtaaagcgattggcattatcagcaacaacccggagtttgccgatgtgcgtagcctggaagggctttccccgaccaataaacccagtgtaccgattctggcaattcctaccacagcaggtactgcggcagaagtgaccattaactacgtgatcactgacgaagagaaacggcgcaagtttgtttgcgttgatccgcatgatatcccgcaggtggcgtttattgacgctgacatgatggatggtatgcctccagcgctgaaagctgcgacgggtgtcgatgcgctcactcatgctattgaggggtatattacccgtggcgcgtgggcgctaaccgatgcactgcacattaaagcgattgaaatcattgctggggcgctgcgaggatcggttgctggtgataaggatgccggagaagaaatggcgctcgggcagtatgttgcgggtatgggcttctcgaatgttgggttagggttggtgcatggtatggcgcatccactgggcgcgttttataacactccacacggtgttgcgaacgccatcctgttaccgcatgtcatgcgttataacgctgactttaccggtgagaagtaccgcgatatcgcgcgcgttatgggcgtgaaagtggaaggtatgagcctggaagaggcgcgtaatgccgctgttgaagcggtgtttgctctcaaccgtgatgtcggtattccgccacatttgcgtgatgttggtgtacgcaaggaagacattccggcactggcgcaggcggcactggatgatgtttgtaccggtggcaacccgcgtgaagcaacgcttgaggatattgtagagctttaccataccgcctggtaa

SEQ ID NO: 27 - DNA, 1149 bp, Artificial Sequence; identical to SEQ ID NO: 26
  Codon Optimized E. coli Sequence

SEQ ID NO: 28 - protein, 382 aa, Escherichia coli
MANRMILNETAWFGRGAVGALTDEVKRRGYQKALIVTDKTLVQCGVVAKVTDKMDAAGLAWAIYDGVVPNPTITVVKEGLGVFQNSGADYLIAIGGGSPQDTCKAIGIISNNPEFADVRSLEGLSPTNKPSVPILAIPTTAGTAAEVTINYVITDEEKRRKFVCVDPHDIPQVAFIDADMMDGMPPALKAATGVDALTHAIEGYITRGAWALTDALHIKAIEIIAGALRGSVAGDKDAGEEMALGQYVAGMGFSNVGLGLVHGMAHPLGAFYNTPHGVANAILLPHVMRYNADFTGEKYRDIARVMGVKVEGMSLEEARNAAVEAVFALNRDVGIPPHLRDVGVRKEDIPALAQAALDDVCTGGNPREATLEDIVELYHTAW

SEQ ID NO: 29 - DNA, 804 bp, Escherichia coli
atggctatccctgcatttggtttaggtactttccgtctgaaagacgacgttgttatttcatctgtgataacggcgcttgaacttggttatcgcgcaattgataccgcacaaatctatgataacgaagccgcagtaggtcaggcgattgcagaaagtggcgtgccacgtcatgaactctacatcaccactaaaatctggattgaaaatctcagcaaagacaaattgatcccaagtctgaaagagagcctgcaaaaattgcgtaccgattatgttgatctgacgctaatccactggccgtcaccaaacgatgaagtctctgttgaagagtttatgcaggcgctgctggaagccaaaaaacaagggctgacgcgtgagatcggtatttccaacttcacgatcccgttgatggaaaaagcgattgctgctgttggtgctgaaaacatcgctactaaccagattgaactctctccttatctgcaaaaccgtaaagtggttgcctgggctaaacagcacggcatccatattacttcctatatgacgctggcgtatggtaaggccctgaaagatgaggttattgctcgtatcgcagctaaacacaatgcgactccggcacaagtgattctggcgtgggctatgggggaaggttactcagtaattccttcttctactaaacgtaaaaacctggaaagtaatcttaaggcacaaaatttacagcttgatgccgaagataaaaaagcgatcgccgcactggattgcaacgaccgcctggttagcccggaaggtctggctcctgaatgggattaa

SEQ ID NO: 30 - protein, 267 aa, Escherichia coli
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRKNLESNLKAQNLQLDAEDKKAIAALDCNDRLVSPEGLAPEWD

SEQ ID NO: 31 - DNA, 828 bp, Escherichia coli
atggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaa

SEQ ID NO: 32 - protein, 275 aa, Escherichia coli
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGEIAKLDQGKRLGPDPDQFGG

SEQ ID NO: 33 - DNA, 1179 bp, Clostridium acetobutylicum
atgaaagaagttgtaatagctagtgcagtaagaacagcgattggatcttatggaaagtctcttaaggatgtaccagcagtagatttaggagctacagctataaaggaagcagttaaaaaagcaggaataaaaccagaggatgttaatgaagtcattttaggaaatgttcttcaagcaggtttaggacagaatccagcaagacaggcatcttttaaagcaggattaccagttgaaattccagctatgactattaataaggtttgtggttcaggacttagaacagttagcttagcagcacaaattataaaagcaggagatgctgacgtaataatagcaggtggtatggaaaatatgtctagagctccttacttagcgaataacgctagatggggatatagaatgggaaacgctaaatttgttgatgaaatgatcactgacggattgtgggatgcatttaatgattaccacatgggaataacagcagaaaacatagctgagagatggaacatttcaagagaagaacaagatgagtttgctcttgcatcacaaaaaaaagctgaagaagctataaaatcaggtcaatttaaagatgaaatagttcctgtagtaattaaaggcagaaagggagaaactgtagttgatacagatgagcaccctagatttggatcaactatagaaggacttgcaaaattaaaacctgccttcaaaaaagatggaacagttacagctggtaatgcatcaggattaaatgactgtgcagcagtacttgtaatcatgagtgcagaaaaagctaaagagcttggagtaaaaccacttgctaagatagtttcttatggttcagcaggagttgacccagcaataatgggatatggacctttctatgcaacaaaagcagctattgaaaaagcaggttggacagttgatgaattagatttaatagaatcaaatgaagcttttgcagctcaaagtttagcagtagcaaaagatttaaaatttgatatgaataaagtaaatgtaaatggaggagctattgcccttggtcatccaattggagcatcaggtgcaagaatactcgttactcttgtacacgcaatgcaaaaaagagatgcaaaaaaaggcttagcaactttatgtataggtggcggacaaggaacagcaatattgctagaaaagtgctag

SEQ ID NO: 34 - DNA, 1179 bp, Artificial Sequence
  Codon Aoptimized Clostridium acetobutylicum Sequence
atgaaagaagttgttattgcgagcgcggttcgtaccgcgattggcagctatggcaagagcctgaaggatgttccggcggtggacctgggtgcgaccgcgatcaaagaggcggttaagaaagcgggcattaaaccggaggatgtgaacgaagttatcctgggtaacgtgctgcaagcgggtctgggccaaaacccggcgcgtcaggcgagcttcaaggcgggcctgccggttgaaatcccggcgatgaccattaacaaagtttgcggtagcggcctgcgtaccgtgagcctggcggcgcaaatcattaaggcgggtgacgcggatgttatcattgcgggtggcatggagaacatgagccgtgcgccgtacctggcgaacaacgcgcgttggggttatcgtatgggcaacgcgaaattcgtggacgaaatgattaccgacggtctgtgggatgcgtttaacgactaccacatgggcatcaccgcggagaacattgcggaacgttggaacattagccgtgaggaacaagatgagttcgcgctggcgagccagaagaaagcggaggaagcgatcaagagcggccagtttaaagacgaaatcgttccggtggttattaagggtcgtaagggtgaaaccgtggtggacaccgatgaacacccgcgtttcggtagcaccattgagggcctggcgaagctgaaaccggcgtttaagaaagatggcaccgtgaccgcgggtaacgcgagcggcctgaacgactgcgcggcggtgctggttatcatgagcgcggagaaggcgaaagaactgggtgtgaagccgctggcgaaaattgttagctacggtagcgcgggtgtggacccggcgatcatgggttacggcccgttttatgcgaccaaggcggcgattgagaaagcgggttggaccgtggacgaactggatctgatcgagagcaacgaagcgttcgcggcgcaaagcctggcggtggcgaaggatctgaaatttgacatgaacaaggtgaacgtgaacggtggtgcgattgcgctgggtcacccgattggtgcgagcggcgcgcgtatcctggtgaccctggttcacgcgatgcagaaacgtgacgcgaagaaaggtctggcgaccctgtgcattggtggtggtcaaggcaccgcgattctgctggaaaagtgctaa

SEQ ID NO: 35 - protein, 392 aa, Clostridium acetobutylicum
MKEVVIASAVRTAIGSYGKSLKDVPAVDLGATAIKEAVKKAGIKPEDVNEVILGNVLQAGLGQNPARQASFKAGLPVEIPAMTINKVCGSGLRTVSLAAQIIKAGDADVIIAGGMENMSRAPYLANNARWGYRMGNAKFVDEMITDGLWDAFNDYHMGITAENIAERWNISREEQDEFALASQKKAEEAIKSGQFKDEIVPVVIKGRKGETVVDTDEHPRFGSTIEGLAKLKPAFKKDGTVTAGNASGLNDCAAVLVIMSAEKAKELGVKPLAKIVSYGSAGVDPAIMGYGPFYATKAAIEKAGWTVDELDLIESNEAFAAQSLAVAKDLKFDMNKVNVNGGAIALGHPIGASGARILVTLVHAMQKRDAKKGLATLCIGGGQGTAILLEKC

SEQ ID NO: 36 - DNA, 1185 bp, Escherichia coli
atgaaaaattgtgtcatcgtcagtgcggtacgtactgctatcggtagttttaacggttcactcgcttccaccagcgccatcgacctgggggcgacagtaattaaagccgccattgaacgtgcaaaaatcgattcacaacacgttgatgaagtgattatgggtaacgtgttacaagccgggctggggcaaaatccggcgcgtcaggcactgttaaaaagcgggctggcagaaacggtgtgcggattcacggtcaataaagtatgtggttcgggtcttaaaagtgtggcgcttgccgcccaggccattcaggcaggtcaggcgcagagcattgtggcggggggtatggaaaatatgagtttagccccctacttactcgatgcaaaagcacgctctggttatcgtcttggagacggacaggtttatgacgtaatcctgcgcgatggcctgatgtgcgccacccatggttatcatatggggattaccgccgaaaacgtggctaaagagtacggaattacccgtgaaatgcaggatgaactggcgctacattcacagcgtaaagcggcagccgcaattgagtccggtgcttttacagccgaaatcgtcccggtaaatgttgtcactcgaaagaaaaccttcgtcttcagtcaagacgaattcccgaaagcgaattcaacggctgaagcgttaggtgcattgcgcccggccttcgataaagcaggaacagtcaccgctgggaacgcgtctggtattaacgacggtgctgccgctctggtgattatggaagaatctgcggcgctggcagcaggccttacccccctggctcgcattaaaagttatgccagcggtggcgtgccccccgcattgatgggtatggggccagtacctgccacgcaaaaagcgttacaactggcggggctgcaactggcggatattgatctcattgaggctaatgaagcatttgctgcacagttccttgccgttgggaaaaacctgggctttgattctgagaaagtgaatgtcaacggcggggccatcgcgctcgggcatcctatcggtgccagtggtgctcgtattctggtcacactattacatgccatgcaggcacgcgataaaacgctggggctggcaacactgtgcattggcggcggtcagggaattgcgatggtgattgaacggttgaattaa

SEQ ID NO: 37 - protein, 394 aa, Escherichia coli
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLN

SEQ ID NO: 38 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 39 - DNA, 1197 bp, Artificial Sequence; identical to SEQ ID NO: 38
  Codon Optimized Sacharomyces cerevisiae Sequence

SEQ ID NO: 40 - protein, 398 aa, Saccharomyces cerevisiae
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 41 - DNA, 651 bp, Escherichia coli
atggatgcgaaacaacgtattgcgcgccgtgtggcgcaagagcttcgtgatggtgacatcgttaacttagggatcggtttacccacaatggtcgccaattatttaccggagggtattcatatcactctgcaatcggaaaacggcttcctcggtttaggcccggtcacgacagcgcatccagatctggtgaacgctggcgggcaaccgtgcggtgttttacccggtgcagccatgtttgatagcgccatgtcatttgcgctaatccgtggcggtcatattgatgcctgcgtgctcggcggtttgcaagtagacgaagaagcaaacctcgcgaactgggtagtgcctgggaaaatggtgcccggtatgggtggcgcgatggatctggtgaccgggtcgcgcaaagtgatcatcgccatggaacattgcgccaaagatggttcagcaaaaattttgcgccgctgcaccatgccactcactgcgcaacatgcggtgcatatgctggttactgaactggctgtctttcgttttattgacggcaaaatgtggctcaccgaaattgccgacgggtgtgatttagccaccgtgcgtgccaaaacagaagctcggtttgaagtcgccgccgatctgaatacgcaacggggtgatttatga

SEQ ID NO: 42 - DNA, 651 bp, Artificial Sequence; identical to SEQ ID NO: 41
  Codon Optimized E. coli Sequence

SEQ ID NO: 43 - protein, 216 aa, Escherichia coli
MDAKQRIARRVAQELRDGDIVNLGIGLPTMVANYLPEGIHITLQSENGFLGLGPVTTAHPDLVNAGGQPCGVLPGAAMFDSAMSFALIRGGHIDACVLGGLQVDEEANLANWVVPGKMVPGMGGAMDLVTGSRKVIIAMEHCAKDGSAKILRRCTMPLTAQHAVHMLVTELAVFRFIDGKMWLTEIADGCDLATVRAKTEARFEVAADLNTQRGDL

SEQ ID NO: 44 - DNA, 663 bp, Escherichia coli
atgaaaacaaaattgatgacattacaagacgccaccggcttctttcgtgacggcatgaccatcatggtgggcggatttatggggattggcactccatcccgcctggttgaagcattactggaatctggtgttcgcgacctgacattgatagccaatgataccgcgtttgttgataccggcatcggtccgctcatcgtcaatggtcgagtccgcaaagtgattgcttcacatatcggcaccaacccggaaacaggtcggcgcatgatatctggtgagatggacgtcgttctggtgccgcaaggtacgctaatcgagcaaattcgctgtggtggagctggacttggtggttttctcaccccaacgggtgtcggcaccgtcgtagaggaaggcaaacagacactgacactcgacggtaaaacctggctgctcgaacgcccactgcgcgccgacctggcgctaattcgcgctcatcgttgcgacacacttggcaacctgacctatcaacttagcgcccgcaactttaaccccctgatagcccttgcggctgatatcacgctggtagagccagatgaactggtcgaaaccggcgagctgcaacctgaccatattgtcacccctggtgccgttatcgaccacatcatcgtttcacaggagagcaaataa

SEQ ID NO: 45 - DNA, 663 bp, Artificial Sequence; identical to SEQ ID NO: 44
  Codon Optimized E. coli Sequence

SEQ ID NO: 46 - protein, 220 aa, Escherichia coli
MKTKLMTLQDATGFFRDGMTIMVGGFMGIGTPSRLVEALLESGVRDLTLIANDTAFVDTGIGPLIVNGRVRKVIASHIGTNPETGRRMISGEMDVVLVPQGTLIEQIRCGGAGLGGFLTPTGVGTVVEEGKQTLTLDGKTWLLERPLRADLALIRAHRCDTLGNLTYQLSARNFNPLIALAADITLVEPDELVETGELQPDHIVTPGAVIDHIIVSQESK

SEQ ID NO: 47 - DNA, 735 bp, Clostridium acetobutylicum
atgttaaaggatgaagtaattaaacaaattagcacgccattaacttcgcctgcatttcctagaggaccctataaatttcataatcgtgagtattttaacattgtatatcgtacagatatggatgcacttcgtaaagttgtgccagagcctttagaaattgatgagcccttagtcaggtttgaaattatggcaatgcatgatacgagtggacttggttgttatacagaaagcggacaggctattcccgtaagctttaatggagttaagggagattatcttcatatgatgtatttagataatgagcctgcaattgcagtaggaagggaattaagtgcatatcctaaaaagctcgggtatccaaagctttttgtggattcagatactttagtaggaactttagactatggaaaacttagagttgcgacagctacaatggggtacaaacataaagccttagatgctaatgaagcaaaggatcaaatttgtcgccctaattatatgttgaaaataatacccaattatgatggaagccctagaatatgtgagcttataaatgcgaaaatcacagatgttaccgtacatgaagcttggacaggaccaactcgactgcagttatttgatcacgctatggcgccacttaatgatttgccagtaaaagagattgtttctagctctcacattcttgcagatataatattgcctagagctgaagttatatatgattatcttaagtaa

SEQ ID NO: 48 - DNA, 735 bp, Artificial Sequence
  Codon Optimized Clostridium acetobutylicum Sequence
atgctgaaggacgaggttattaagcagattagcaccccgctgaccagcccggcgttcccgcgtggtccgtacaagttccataatcgcgaatacttcaacattgtgtatcgtaccgacatggatgcgctgcgtaaggtggttccggagccgctggaaattgacgagccgctggttcgtttcgaaatcatggcgatgcacgataccagcggtctgggctgctacaccgagagcggtcaggcgattccggtgagctttaacggtgttaaaggcgactacctgcacatgatgtatctggataacgaaccggcgattgcggtgggtcgtgagctgagcgcgtacccgaagaaactgggctatccgaagctgttcgtggacagcgataccctggtgggcaccctggactacggcaaactgcgtgttgcgaccgcgaccatgggctataagcacaaagcgctggacgcgaacgaagcgaaggatcagatttgccgtccgaactacatgctgaaaatcattccgaactatgacggtagcccgcgtatctgcgaactgattaacgcgaagatcaccgatgttaccgttcatgaggcgtggaccggcccgacccgtctgcaactgtttgaccacgcgatggcgccgctgaacgatctgccggtgaaagagatcgttagcagcagccacatcctggcggacatcatcctgccgcgtgcggaagttatctacgattacctgaagtaa

SEQ ID NO: 49 - protein, 244 aa, Clostridium acetobutylicum
MLKDEVIKQISTPLTSPAFPRGPYKFHNREYFNIVYRTDMDALRKVVPEPLEIDEPLVRFEIMAMHDTSGLGCYTESGQAIPVSFNGVKGDYLHMMYLDNEPAIAVGRELSAYPKKLGYPKLFVDSDTLVGTLDYGKLRVATATMGYKHKALDANEAKDQICRPNYMLKIIPNYDGSPRICELINAKITDVTVHEAWTGPTRLQLFDHAMAPLNDLPVKEIVSSSHILADIILPRAEVIYDYLK

SEQ ID NO: 50 - DNA, 741 bp, Clostridium beijerinckii
atgttagaaagtgaagtatctaaacaaattacaactccacttgctgctccagcgtttcctagaggaccatataggtttcacaatagagaatatctaaacattatttatcgaactgatttagatgctcttcgaaaaatagtaccagagccacttgaattagatagagcatatgttagatttgaaatgatggctatgcctgatacaaccggactaggctcatatacagaatgtggtcaagctattccagtaaaatataatggtgttaagggtgactacttgcatatgatgtatctagataatgaacctgctattgctgttggaagagaaagtagcgcttatccaaaaaagcttggctatccaaagctatttgttgattcagatactttagttgggacacttaaatatggtacattaccagtagctactgcaacaatgggatataagcacgagcctctagatcttaaagaagcctatgctcaaattgcaagacccaattttatgctaaaaatcattcaaggttacgatggtaagccaagaatttgtgaactaatatgtgcagaaaatactgatataactattcacggtgcttggactggaagtgcacgtctacaattatttagccatgcactagctcctcttgctgatttacctgtattagagattgtatcagcatctcatatcctcacagatttaactcttggaacacctaaggttgtacatgattatctttcagtaaaataa

SEQ ID NO: 51 - DNA, 741 bp, Artificial Sequence
  Codon Optimized Clostridium beijerinckii Sequence
atgctggagagcgaagttagcaaacaaatcaccaccccgctggcggcgccggcgttcccgcgtggcccgtaccgttttcataaccgtgagtacctgaacatcatttatcgtaccgacctggatgcgctgcgtaagattgtgccggagccgctggaactggaccgtgcgtacgttcgtttcgagatgatggcgatgccggataccaccggtctgggcagctacaccgaatgcggtcaggcgatcccggtgaagtataacggtgttaaaggcgactacctgcacatgatgtatctggataacgagccggcgattgcggtgggtcgtgaaagcagcgcgtacccgaagaaactgggctatccgaagctgtttgtggacagcgataccctggtgggcaccctgaaatatggcaccctgccggttgcgaccgcgaccatgggctacaagcacgagccgctggacctgaaagaagcgtatgcgcagattgcgcgtccgaacttcatgctgaagatcattcaaggttatgacggcaaaccgcgtatctgcgagctgatttgcgcggaaaacaccgatatcaccatccatggtgcgtggaccggcagcgcgcgtctgcaactgtttagccatgcgctggcgccgctggcggatctgccggtgctggaaatcgttagcgcgagccacattctgaccgatctgaccctgggcaccccgaaggttgtgcatgactatctgagcgtgaagtaa

SEQ ID NO: 52 - protein, 246 aa, Clostridium beijerinckii
MLESEVSKQITTPLAAPAFPRGPYRFHNREYLNIIYRTDLDALRKIVPEPLELDRAYVRFEMMAMPDTTGLGSYTECGQAIPVKYNGVKGDYLHMMYLDNEPAIAVGRESSAYPKKLGYPKLFVDSDTLVGTLKYGTLPVATATMGYKHEPLDLKEAYAQIARPNFMLKIIQGYDGKPRICELICAENTDITIHGAWTGSARLQLFSHALAPLADLPVLEIVSASHILTDLTLGTPKVVHDYLSVK

SEQ ID NO: 53 - DNA, 770 bp, Homo sapiens
atggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccgttctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctgg

SEQ ID NO: 54 - DNA, 897 bp, Artificial Sequence
  Codon Optimized Homo sapiens Sequence
atggaggaaaagcaaattctgtgcgttggtctggtggttctggacgtgattagcctggttgataagtacccgaaagaggatagcgaaatccgttgcctgagccagcgttggcaacgtggtggcaacgcgagcaatagctgcaccgttctgagcctgctgggtgcgccgtgcgcgttcatgggtagcatggcgccgggtcatgttgcggacttcctggtggcggattttcgtcgtcgtggtgtggacgttagccaggttgcgtggcaaagcaagggcgataccccgagctcctgctgcatcattaacaacagcaacggtaaccgtaccattgtgctgcacgacaccagcctgccggatgttagcgcgaccgacttcgagaaggtggatctgacccagtttaaatggattcacattgagggccgtaacgcgagcgaacaggttaaaatgctgcaacgtattgatgcgcacaacacccgtcagccgccggaacaaaagattcgtgtgagcgttgaggtggaaaaaccgcgtgaggaactgttccaactgtttggttacggcgacgtggttttcgttagcaaggatgtggcgaaacacctgggttttcaaagcgcggaggaagcgctgcgtggtctgtatggccgtgtgcgtaaaggcgcggttctggtgtgcgcgtgggcggaggaaggcgcggatgcgctgggtccggatggcaaactgctgcacagcgatgcgttcccgccgccgcgtgtggttgacaccctgggtgcgggcgataccttcaacgcgagcgttatctttagcctgagccagggccgtagcgtgcaagaggcgctgcgtttcggctgccaagttgcgggtaaaaaatgcggtctgcaaggctttgacggtatcgtgtaa

SEQ ID NO: 55 - protein, 298 aa, Homo sapiens
MEEKQILCVGLVVLDVISLVDKYPKEDSEIRCLSQRWQRGGNASNSCTVLSLLGAPCAFMGSMAPGHVADFLVADFRRRGVDVSQVAWQSKGDTPSSCCIINNSNGNRTIVLHDTSLPDVSATDFEKVDLTQFKWIHIEGRNASEQVKMLQRIDAHNTRQPPEQKIRVSVEVEKPREELFQLFGYGDVVFVSKDVAKHLGFQSAEEALRGLYGRVRKGAVLVCAWAEEGADALGPDGKLLHSDAFPPPRVVDTLGAGDTFNASVIFSLSQGRSVQEALRFGCQVAGKKCGLQGFDGIV

SEQ ID NO: 56 - DNA, 1095 bp, Homo sapiens
atggcccaccgatttccagccctcacccaggagcagaagaaggagctctcagaaattgcccagagcattgttgccaatggaaaggggatcctggctgcagatgaatctgtaggtaccatggggaaccgcctgcagaggatcaaggtggaaaacactgaagagaaccgccggcagttccgagaaatcctcttctctgtggacagttccatcaaccagagcatcgggggtgtgatccttttccacgagaccctctaccagaaggacagccagggaaagctgttcagaaacatcctcaaggaaaaggggatcgtggtgggaatcaagttagaccaaggaggtgctcctcttgcaggaacaaacaaagaaaccaccattcaagggcttgatggcctctcagagcgctgtgctcagtacaagaaagatggtgttgactttgggaagtggcgtgctgtgctgaggattgccgaccagtgtccatccagcctcgctatccaggaaaacgccaacgccctggctcgctacgccagcatctgtcagcagaatggactggtacctattgttgaaccagaggtaattcctgatggagaccatgacctggaacactgccagtatgttactgagaaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgcagctgttcctggcatctgctttttgtctggtggcatgagtgaagaggatgccactctcaacctcaatgctatcaacctttgccctctaccaaagccctggaaactaagtttctcttatggacgggccctgcaggccagtgcactggctgcctggggtggcaaggctgcaaacaaggaggcaacccaggaggcttttatgaagcgggccatggctaactgccaggcggccaaaggacagtatgttcacacgggttcttctggggctgcttccacccagtcgctcttcacagcctgctatacctactag

SEQ ID NO: 57 - DNA, 1095 bp, Artificial Sequence
  Codon Optimized Homo sapiens Sequence
atggcgcaccgttttccggcgctgacccaagagcagaagaaggagctgagcgagattgcgcagagcatcgtggcgaatggtaaaggtattctggcggcggatgagagcgttggtaccatgggcaaccgtctgcagcgtattaaggtggagaacaccgaggaaaaccgtcgtcaattccgtgaaatcctgtttagcgttgatagcagcatcaaccagagcattggtggcgtgatcctgttccacgaaaccctgtaccagaaggacagccaaggtaaactgtttcgtaacattctgaaggaaaaaggtattgtggttggcatcaagctggatcaaggtggcgcgccgctggcgggcaccaacaaggaaaccaccatccagggtctggacggcctgagcgaacgttgcgcgcaatataagaaagatggtgttgacttcggcaagtggcgtgcggtgctgcgtattgcggaccagtgcccgagcagcctggcgatccaagaaaacgcgaacgcgctggcgcgttacgcgagcatctgccagcaaaacggtctggtgccgattgttgagccggaagttatcccggacggcgatcacgacctggagcactgccagtatgtgaccgaaaaggttctggcggcggtgtacaaagcgctgaacgatcaccacgtttatctggagggtaccctgctgaaaccgaacatggtgaccgcgggccatgcgtgcaccaagaaatacaccccggaacaggtggcgatggcgaccgtgaccgcgctgcaccgtaccgttccggcggcggtgccgggtatttgctttctgagcggtggcatgagcgaagaggacgcgaccctgaacctgaacgcgatcaacctgtgcccgctgccgaagccgtggaaactgagcttcagctacggccgtgcgctgcaggcgagcgcgctggcggcgtggggtggcaaggcggcgaacaaagaggcgacccaagaagcgtttatgaagcgtgcgatggcgaactgccaggcggcgaaaggtcaatatgtgcataccggcagcagcggtgcggcgagcacccagagcctgtttaccgcgtgctatacctattaa

SEQ ID NO: 58 - protein, 364 aa, Homo sapiens
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVVGIKLDQGGAPLAGTNKETTIQGLDGLSERCAQYKKDGVDFGKWRAVLRIADQCPSSLAIQENANALARYASICQQNGLVPIVEPEVIPDGDHDLEHCQYVTEKVLAAVYKALNDHHVYLEGTLLKPNMVTAGHACTKKYTPEQVAMATVTALHRTVPAAVPGICFLSGGMSEEDATLNLNAINLCPLPKPWKLSFSYGRALQASALAAWGGKAANKEATQEAFMKRAMANCQAAKGQYVHTGSSGAASTQSLFTACYTY

SEQ ID NO: 59 - DNA, 747 bp, Caulobacter crescentus
atgtcctcagccatctatcccagcctgaagggcaagcgcgtcgtcatcaccggcggcggctcgggcatcggggccggcctcaccgccggcttcgcccgtcagggcgcggaggtgatcttcctcgacatcgccgacgaggactccagggctcttgaggccgagctggccggctcgccgatcccgccggtctacaagcgctgcgacctgatgaacctcgaggcgatcaaggcggtcttcgccgagatcggcgacgtcgacgtgctggtcaacaacgccggcaatgacgaccgccacaagctggccgacgtgaccggcgcctattgggacgagcggatcaacgtcaacctgcgccacatgctgttctgcacccaggccgtcgcgccgggcatgaagaagcgtggcggcggggcggtgatcaacttcggttcgatcagctggcacctggggcttgaggacctcgtcctctacgaaaccgccaaggccggcatcgaaggcatgacccgcgcgctggcccgggagctgggtcccgacgacatccgcgtcacctgcgtggtgccgggcaacgtcaagaccaagcgccaggagaagtggtacacgcccgaaggcgaggcccagatcgtggcggcccaatgcctgaagggccgcatcgtcccggagaacgtcgccgcgctggtgctgttcctggcctcggatgacgcgtcgctctgcaccggccacgaatactggatcgacgccggctggcgttga

SEQ ID NO: 60 - DNA, 747 bp, Artificial Sequence
  Codon Optimized Caulobacter crescentus Sequence
atgagcagcgcgatctacccgagcctgaaaggtaaacgtgtggtgattaccggcggcggcagcggcattggtgcgggcctgaccgcgggcttcgcgcgtcagggtgcggaagtgatctttctggacattgcggacgaagatagccgtgcgctggaggcggaactggcgggcagcccgatcccgccggtgtacaagcgttgcgatctgatgaacctggaggcgatcaaagcggttttcgcggaaattggcgacgtggatgttctggtgaacaacgcgggtaacgacgaccgtcacaagctggcggatgtgaccggtgcgtattgggatgagcgtattaacgttaacctgcgtcacatgctgttctgcacccaggcggtggcgccgggtatgaagaaacgtggtggcggtgcggttatcaactttggcagcattagctggcacctgggtctggaggacctggtgctgtacgaaaccgcgaaagcgggcatcgagggtatgacccgtgcgctggcgcgtgaactgggtccggacgatattcgtgtgacctgcgtggttccgggtaacgttaagaccaaacgtcaagagaagtggtataccccggagggtgaagcgcagattgttgcggcgcaatgcctgaaaggtcgtattgttccggaaaacgtggcggcgctggttctgtttctggcgagcgatgatgcgagcctgtgcaccggccatgagtattggattgatgcgggctggcgttaa

SEQ ID NO: 61 - protein, 248 aa, Caulobacter crescentus
MSSAIYPSLKGKRVVITGGGSGIGAGLTAGFARQGAEVIFLDIADEDSRALEAELAGSPIPPVYKRCDLMNLEAIKAVFAEIGDVDVLVNNAGNDDRHKLADVTGAYWDERINVNLRHMLFCTQAVAPGMKKRGGGAVINFGSISWHLGLEDLVLYETAKAGIEGMTRALARELGPDDIRVTCVVPGNVKTKRQEKWYTPEGEAQIVAAQCLKGRIVPENVAALVLFLASDDASLCTGHEYWIDAGWR

SEQ ID NO: 62 - DNA, 1173 bp, Haloferax volcanii
atgagccccgcccccaccgacatcgtcgaggagttcacgcgccgcgactggcagggagacgacgtgacgggcaccgtgcgggtcgccatgatcggcctcggctggtggacccgcgacgaggcgattcccgcggtcgaggcgtccgagttctgcgagacgacggtcgtcgtcagcagttcgaaggagaaagccgagggcgcgacggcgttgaccgagtcgataacccacggcctcacctacgacgagttccacgagggggtcgccgccgacgcctacgacgcggtgtacgtcgtcacgccgaacggtctgcatctcccgtacgtcgagaccgccgccgagttggggaaggcggtcctctgcgagaaaccgctggaagcgtcggtcgagcgggccgaaaagctcgtcgccgcctgcgaccgcgccgacgtgcccctgatggtcgcctatcggatgcagaccgagccggccgtccggcgcgcccgcgaactcgtcgaggccggcgtcatcggcgagccggtgttcgtccacggccacatgtcccagcgcctgctcgacgaggtcgtccccgaccccgaccagtggcggctcgaccccgaactctccggcggcgcgaccgtcatggacatcgggctctacccgctgaacaccgcccggttcgtcctcgacgccgaccccgtccgcgtcagggcgaccgcccgcgtcgacgacgaggcgttcgaggccgtcggcgacgagcacgtcagtttcggcgtcgacttcgacgacggcacgctcgcggtctgcaccgccagccagtcggcttaccagttgagccacctccgggtgaccggcaccgagggcgaactcgaaatcgagcccgcgttctacaaccgccaaaagcggggattccgactgtcgtggggggaccagtccgccgactacgacttcgagcaggtaaaccagatgacggaggagttcgactacttcgcgtcccggctcctgtcggattccgaccccgcgcccgacggcgaccacgcgctcgtggacatgcgcgcgatggacgcgatttacgccgcggcggagcgcgggaccgatgtcgccgtcgacgccgccgactccgattccgccgactccgattccgccgacgctgccgccgccaaccacgacgccgaccccgattccgacgggacgtag

SEQ ID NO: 63 - protein, 390 aa, Haloferax volcanii
MSPAPTDIVEEFTRRDWQGDDVTGTVRVAMIGLGWWTRDEAIPAVEASEFCETTVVVSSSKEKAEGATALTESITHGLTYDEFHEGVAADAYDAVYVVTPNGLHLPYVETAAELGKAVLCEKPLEASVERAEKLVAACDRADVPLMVAYRMQTEPAVRRARELVEAGVIGEPVFVHGHMSQRLLDEVVPDPDQWRLDPELSGGATVMDIGLYPLNTARFVLDADPVRVRATARVDDEAFEAVGDEHVSFGVDFDDGTLAVCTASQSAYQLSHLRVTGTEGELEIEPAFYNRQKRGFRLSWGDQSADYDFEQVNQMTEEFDYFASRLLSDSDPAPDGDHALVDMRAMDAIYAAAERGTDVAVDAADSDSADSDSADAAAANHDADPDSDGT

SEQ ID NO: 64 - DNA, 1176 bp, Unknown
  Trichoderma reesei Sequence
atggcgtctggaaacccttacaccctgaaatggggcatcatggccaccggcggaatcgcagagaccttctgcaaggatctcctgtgcaaccccgcgattcgaggcgccgatgatgtgcgccacgagattgtggccgtggcctcttccagcagcagcaagagagcagaggagttcctccagagaatcgacggtgcctttgacgccaagacgtacggatcatacccggaacttgtggcagaccccaacgtcgacatcgtctatgtggcaactccccacagccaccacttccagaacaccatgctggcgctggaagccggcaagaacgtcttgtgcgaaaaggctttcaccgtgacggccgcgcaggcccgaaagctggttgagacggccaaggccaagaagctcttcctgatggaagctgtgtggacacggtactttccgctgagtatcaagattcgagagctcattgccgccggcgagattggcactgtctttcgaacaatcgccgacttgtccatcaacgcaaactcagagcagggtcaagccctgaaattcgcagactcacatcgaatggtcaacccggacctcgcaggcggtgccaccttggatctcggagtctatcccttgacctgggtgttccagaccctgtatcatttgcaaccggaggaagacaaggaggctcccaccgtggttgcttccagcaacaagtacaccactggcgcagacgagaataccgccatcatctgcagcttccctcgccacaacagcattggaattgcttcgacgacgatgagggcggacaccgaccccgagaaggacaccattccggcggtccgaattcaaggatccaagggagaaatccaagtcttcttcccgacctaccgaccgctcaagtacaaggtggtgaagacgaacggcgaggcgcagacggttgactgccccatccccggagaccccgcgcgcaagggctcgggccacggaatgttctgggaggcggacgagtgtgctcgatgccttcgcgatggcaagttggagagtgccacgttgccatggaaggagagcattgtcattatggaaacgatggaggaggcgctgaggcagggtggcgtcacgtatccggagctgattaccacggatgtctatgatcccaagagccctctcaacacggggaatcagtag

SEQ ID NO: 65 - protein, 391 aa, Unknown
  Trichoderma reesei Sequence
MASGNPYTLKWGIMATGGIAETFCKDLLCNPAIRGADDVRHEIVAVASSSSSKRAEEFLQRIDGAFDAKTYGSYPELVADPNVDIVYVATPHSHHFQNTMLALEAGKNVLCEKAFTVTAAQARKLVETAKAKKLFLMEAVWTRYFPLSIKIRELIAAGEIGTVFRTIADLSINANSEQGQALKFADSHRMVNPDLAGGATLDLGVYPLTWVFQTLYHLQPEEDKEAPTVVASSNKYTTGADENTAIICSFPRHNSIGIASTTMRADTDPEKDTIPAVRIQGSKGEIQVFFPTYRPLKYKVVKTNGEAQTVDCPIPGDPARKGSGHGMFWEADECARCLRDGKLESATLPWKESIVIMETMEEALRQGGVTYPELITTDVYDPKSPLNTGNQ

SEQ ID NO: 66 - DNA, 870 bp, Caulobacter crescentus
atgaccgctcaagtcacttgcgtatgggatctgaaggccacgttgggcgaaggcccgatctggcatggcgacaccctgtggttcgtcgacatcaagcagcgtaaaatccacaactaccaccccgccaccggcgagcgcttcagcttcgacgcgccggatcaggtgaccttcctcgcgccgatcgtcggcgcgaccggctttgtcgtcggtctgaagaccgggattcaccgcttccacccggccacgggcttcagcctgctgctcgaggtcgaggacgcggcgctgaacaaccgccccaacgacgccacggtcgacgcgcaaggccgtctgtggttcggcaccatgcacgacggggaagagaacaatagcggctcgctctatcggatggacctcaccggcgtcgcccggatggaccgcgacatctgcatcaccaacggcccgtgcgtctcgcccgacggcaagaccttctaccacaccgacaccctggaaaagacgatctacgccttcgacctggccgaggacggcctgctgtcgaacaagcgcgtcttcgtgcagttcgccctgggcgacgatgtctatccggacggttcggtcgtcgattccgaaggctatctgtggaccgccctgtggggcggtttcggcgcggtccgcttctcgccgcaaggcgacgccgtgacgcgcatcgaactgcccgcccccaacgtcaccaagccctgcttcggcgggcctgacctgaagaccctctatttcaccaccgcccgcaagggcctgagcgacgagaccctggcccagtacccgctggccggcggtgtgttcgccgttccggtcgatgtggccggccaaccccagcatgaggtccgccttgtctaa

SEQ ID NO: 67 - protein, 289 aa, Caulobacter crescentus
MTAQVTCVWDLKATLGEGPIWHGDTLWFVDIKQRKIHNYHPATGERFSFDAPDQVTFLAPIVGATGFVVGLKTGIHRFHPATGFSLLLEVEDAALNNRPNDATVDAQGRLWFGTMHDGEENNSGSLYRMDLTGVARMDRDICITNGPCVSPDGKTFYHTDTLEKTIYAFDLAEDGLLSNKRVFVQFALGDDVYPDGSVVDSEGYLWTALWGGFGAVRFSPQGDAVTRIELPAPNVTKPCFGGPDLKTLYFTTARKGLSDETLAQYPLAGGVFAVPVDVAGQPQHEVRLV

SEQ ID NO: 68 - DNA, 1776 bp, Caulobacter crescentus
ttgtctaaccgcacgccccgccggttccggtcccgcgattggttcgataaccccgaccatatcgacatgaccgcgctctatctggagcgcttcatgaactacgggatcacgccggaggagctgcgcagcggcaagccgatcatcggcatcgcccagaccggcagcgacatctcgccctgcaaccgcatccacctggacctggtccagcgggtgcgggacgggatccgcgacgccgggggcatccccatggagttcccggtccatccgatcttcgagaactgccgtcgcccgacggcggcgctggaccggaacctctcgtacctgggtctcgtcgagaccctgcacggctatccgatcgacgccgtggttctgaccaccggctgcgacaagaccaccccggccgggatcatggccgccaccacggtcaatatcccggccatcgtgctgtcgggcggcccgatgctggacggctggcacgagaacgagctcgtgggctcgggcaccgtgatctggcgctcgcgccgcaagctggcggccggcgagatcaccgaggaagagttcatcgaccgcgccgccagctcggcgccgtcggcgggccactgcaacaccatgggcacggcctcgaccatgaacgccgtggccgaggcgctgggcctgtcgctgaccggctgcgcggccatccccgccccctaccgcgagcgcggccagatggcctacaagaccggccagcgcatcgtcgatctggcctatgacgacgtcaaaccgctcgacatcctgaccaagcaagccttcgagaacgccatcgccctggtggcggcggccggcggctcgaccaacgcccagccgcacatcgtggccatggcccgtcacgccggcgtcgagatcaccgccgacgactggcgcgcggcctatgacatcccgctgatcgtcaacatgcagccggccggcaagtatctgggcgagcgcttccaccgagccggcggcgcgccggcggtgctgtgggagctgttgcagcaaggccgcctgcacggcgacgtgctgaccgtcaccggcaagacgatgagcgagaacctgcaaggccgcgaaaccagcgaccgcgaggtgatcttcccgtaccacgagccgctggccgagaaggccgggttcctggttctcaagggcaacctcttcgacttcgcgatcatgaagtccagcgtgatcggcgaggagttccgcaagcgctacctgtcgcagcccggccaggaaggcgtgttcgaagcccgcgccatcgtgttcgacggctcggacgactatcacaagcggatcaacgatccggccctggagatcgacgagcgctgcatcctggtgatccgcggcgcgggtccgatcggctggcccggctcggccgaggtcgtcaacatgcagccgccggatcaccttctgaagaaggggatcatgagcctgcccaccctgggcgatggccgtcagtcgggcaccgccgacagcccctcgatcctgaacgcctcgcccgaaagcgcgatcggcggcggcctgtcgtggctgcgcaccggcgacaccatccgcatcgacctcaacaccggccgctgcgacgccctggtcgacgaggcgacgatcgccgcgcgcaagcaggacggcatcccggcggttcccgccaccatgacgccctggcaggaaatctaccgcgcccacgccagtcagctcgacaccggcggcgtgctggagttcgcggtcaagtaccaggacctggcggccaagctgccccgccacaaccactga

SEQ ID NO: 69 - protein, 591 aa, Caulobacter crescentus
MSNRTPRRFRSRDWFDNPDHIDMTALYLERFMNYGITPEELRSGKPIIGIAQTGSDISPCNRIHLDLVQRVRDGIRDAGGIPMEFPVHPIFENCRRPTAALDRNLSYLGLVETLHGYPIDAVVLTTGCDKTTPAGIMAATTVNIPAIVLSGGPMLDGWHENELVGSGTVIWRSRRKLAAGEITEEEFIDRAASSAPSAGHCNTMGTASTMNAVAEALGLSLTGCAAIPAPYRERGQMAYKTGQRIVDLAYDDVKPLDILTKQAFENAIALVAAAGGSTNAQPHIVAMARHAGVEITADDWRAAYDIPLIVNMQPAGKYLGERFHRAGGAPAVLWELLQQGRLHGDVLTVTGKTMSENLQGRETSDREVIFPYHEPLAEKAGFLVLKGNLFDFAIMKSSVIGEEFRKRYLSQPGQEGVFEARAIVFDGSDDYHKRINDPALEIDERCILVIRGAGPIGWPGSAEVVNMQPPDHLLKKGIMSLPTLGDGRQSGTADSPSILNASPESAIGGGLSWLRTGDTIRIDLNTGRCDALVDEATIAARKQDGIPAVPATMTPWQEIYRAHASQLDTGGVLEFAVKYQDLAAKLPRHNH

SEQ ID NO: 70 - DNA, 1968 bp, Escherichia coli
atgtctgttcgcaatatttttgctgacgagagccacgatatttacaccgtcagaacgcacgccgatggcccggacggcgaactcccattaaccgcagagatgcttatcaaccgcccgagcggggatctgttcggtatgaccatgaatgccggaatgggttggtctccggacgagctggatcgggacggtattttactgctcagtacactcggtggcttacgcggcgcagacggtaaacccgtggcgctggcgttgcaccaggggcattacgaactggacatccagatgaaagcggcggccgaggttattaaagccaaccatgccctgccctatgccgtgtacgtctccgatccttgtgacgggcgtactcagggtacaacggggatgtttgattcgctaccataccgaaatgacgcatcgatggtaatgcgccgccttattcgctctctgcccgacgcgaaagcagttattggtgtggcgagttgcgataaggggcttccggccaccatgatggcactcgccgcgcagcacaacatcgcaaccgtgctggtccccggcggcgcgacgctgcccgcaaaggatggagaagacaacggcaaggtgcaaaccattggcgcacgcttcgccaatggcgaattatctctacaggacgcacgccgtgcgggctgtaaagcctgtgcctcttccggcggcggctgtcaatttttgggcactgccgggacatctcaggtggtggccgaaggattgggactggcaatcccacattcagccctggccccttccggtgagcctgtgtggcgggagatcgccagagcttccgcgcgagctgcgctgaacctgagtcaaaaaggcatcaccacccgggaaattctcaccgataaagcgatagagaatgcgatgacggtccatgccgcgttcggtggttcaacaaacctgctgttacacatcccggcaattgctcaccaggcaggttgccatatcccgaccgttgatgactggatccgcatcaacaagcgcgtgccccgactggtgagcgtactgcctaatggcccggtttatcatccaacggtcaatgcctttatggcaggtggtgtgccggaagtcatgttgcatctgcgcagcctcggattgttgcatgaagacgttatgacggttaccggcagcacgctgaaagaaaacctcgactggtgggagcactccgaacggcgtcagcggttcaagcaactcctgctcgatcaggaacaaatcaacgctgacgaagtgatcatgtctccgcagcaagcaaaagcgcgcggattaacctcaactatcaccttcccggtgggcaatattgcgccagaaggttcggtgatcaaatccaccgccattgacccctcgatgattgatgagcaaggtatctattaccataaaggtgtggcgaaggtttatctgtccgagaaaagtgcgatttacgatatcaaacatgacaagatcaaggcgggcgatattctggtcattattggcgttggaccttcaggtacagggatggaagaaacctaccaggttaccagtgccctgaagcatctgtcatacggtaagcatgtttcgttaatcaccgatgcacgtttctcgggcgtttctactggcgcgtgcatcggccatgtggggccagaagcgctggccggaggccccatcggtaaattacgcaccggggatttaattgaaattaaaattgattgtcgcgagcttcacggcgaagtcaatttcctcggaacccgtagcgatgaacaattaccttcacaggaggaggcaactgcaatattaaatgccagacccagccatcaggatttacttcccgatcctgaattgccagatgatacccggctatgggcaatgcttcaggccgtgagtggtgggacatggaccggttgtatttatgatgtaaacaaaattggcgcggctttgcgcgattttatgaataaaaactga

SEQ ID NO: 71 - DNA, 1968 bp, Artificial Sequence; identical to SEQ ID NO: 70
  Codon Optimized E. coli Sequence

SEQ ID NO: 72 - protein, 655 aa, Escherichia coli [sequence omitted]

SEQ ID NO: 73 - DNA, 1968 bp, Escherichia coli
atgaccattgagaaaattttcaccccgcaggacgacgcgttttatgcggtgatcacccacgcggcggggccgcagggcgctctgccgctgaccccgcagatgctgatggaatctcccagcggcaacctgttcggcatgacgcagaacgccgggatgggctgggacgccaacaagctcaccggcaaagaggtgctgattatcggcactcagggcggcatccgcgccggagacggacgcccaatcgcgctgggctaccacaccgggcattgggagatcggcatgcagatgcaggcggcggcgaaggagatcacccgcaatggcgggatcccgttcgcggccttcgtcagcgatccgtgcgacgggcgctcgcagggcacgcacggtatgttcgattccctgccgtaccgcaacgacgcggcgatcgtgtttcgccgcctgatccgctccctgccgacgcggcgggcggtgatcggcgtagcgacctgcgataaagggctgcccgccaccatgattgcgctggccgcgatgcacgacctgccgactattctggtgccgggcggggcgacgctgccgccgaccgtcggggaagacgcgggcaaggtgcagaccatcggcgcgcgtttcgccaaccacgaactctccctgcaggaggccgccgaactgggctgtcgcgcctgcgcctcgccgggcggcgggtgtcagttcctcggcacggcgggcacctcgcaggtggtcgcggaggcgctgggtctggcgctgccgcactccgcgctggcgccgtccgggcaggcggtgtggctggagatcgcccgccagtcggcgcgcgcggtcagcgagctggatagccgcggcatcaccacgcgggatatcctctccgataaagccatcgaaaacgcgatggtgatccacgcggcgttcggcggctccaccaatttactgctgcacattccggccatcgcccacgcggcgggctgcacgatcccggacgttgagcactggacgcgcatcaaccgtaaagtgccgcgtctggtgagcgtgctgcccaacggcccggactatcacccgaccgtgcgcgccttcctcgcgggcggcgtgccggaggtgatgctccacctgcgcgacctcggcctgctgcatctggacgccatgaccgtgaccggccagacggtgggcgagaaccttgaatggtggcaggcgtccgagcgccgggcgcgcttccgccagtgcctgcgcgagcaggacggcgtagagccggatgacgtgatcctgccgccggagaaggcaaaagcgaaagggctgacctcgacggtctgcttcccgacgggcaacatcgctccggaaggttcggtgatcaaggccacggcgatcgacccgtcggtggtgggcgaagatggcgtataccaccacaccggccgggtgcgggtgtttgtctcggaagcgcaggcgatcaaggcgatcaagcgggaagagattgtgcagggcgatatcatggtggtgatcggcggcgggccgtccggcaccggcatggaagagacctaccagctcacctccgcgctaaagcatatctcgtggggcaagacggtgtcgctcatcaccgatgcgcgcttctcgggcgtgtcgacgggcgcctgcttcggccacgtgtcgccggaggcgctggcgggcgggccgattggcaagctgcgcgataacgacatcatcgagattgccgtggatcgtctgacgttaactggcagcgtgaacttcatcggcaccgcggacaacccgctgacgccggaagagggcgcgcgcgagctggcgcggcggcagacgcacccggacctgcacgcccacgactttttgccggacgacacccggctgtgggcggcactgcagtcggtgagcggcggcacctggaaaggctgtatttatgacaccgataaaattatcgaggtaattaacgccggtaaaaaagcgctcggaatttaa

SEQ ID NO: 74 - DNA, 1968 bp, Artificial Sequence; identical to SEQ ID NO: 73
  Codon Optimized E. coli Sequence

SEQ ID NO: 75 - protein, 655 aa, Escherichia coli
MTIEKIFTPQDDAFYAVITHAAGPQGALPLTPQMLMESPSGNLFGMTQNAGMGWDANKLTGKEVLIIGTQGGIRAGDGRPIALGYHTGHWEIGMQMQAAAKEITRNGGIPFAAFVSDPCDGRSQGTHGMFDSLPYRNDAAIVFRRLIRSLPTRRAVIGVATCDKGLPATMIALAAMHDLPTILVPGGATLPPTVGEDAGKVQTIGARFANHELSLQEAAELGCRACASPGGGCQFLGTAGTSQVVAEALGLALPHSALAPSGQAVWLEIARQSARAVSELDSRGITTRDILSDKAIENAMVIHAAFGGSTNLLLHIPAIAHAAGCTIPDVEHWTRINRKVPRLVSVLPNGPDYHPTVRAFLAGGVPEVMLHLRDLGLLHLDAMTVTGQTVGENLEWWQASERRARFRQCLREQDGVEPDDVILPPEKAKAKGLTSTVCFPTGNIAPEGSVIKATAIDPSVVGEDGVYHHTGRVRVFVSEAQAIKAIKREEIVQGDIMVVIGGGPSGTGMEETYQLTSALKHISWGKTVSLITDARFSGVSTGACFGHVSPEALAGGPIGKLRDNDIIEIAVDRLTLTGSVNFIGTADNPLTPEEGARELARRQTHPDLHAHDFLPDDTRLWAALQSVSGGTWKGCIYDTDKIIEVINAGKKALGI

SEQ ID NO: 76 - DNA, 906 bp, Escherichia coli
atgaaaaaattcagcggcattattccaccggtatccagcacgtttcatcgtgacggaacccttgataaaaaggcaatgcgcgaagttgccgacttcctgattaataaaggggtcgacgggctgttttatctgggtaccggtggtgaatttagccaaatgaatacagcccagcgcatggcactcgccgaagaagctgtaaccattgtcgacgggcgagtgccggtattgattggcgtcggttccccttccactgacgaagcggtcaaactggcgcagcatgcgcaagcctacggcgctgatggtatcgtcgccatcaacccctactactggaaagtcgcaccacgaaatcttgacgactattaccagcagatcgcccgtagcgtcaccctaccggtgatcctgtacaactttccggatctgacgggtcaggacttaaccccggaaaccgtgacgcgtctggctctgcaaaacgagaatatcgttggcatcaaagacaccatcgacagcgttggtcacttgcgtacgatgatcaacacagttaagtcggtacgcccgtcgttttcggtattctgcggttacgatgatcatttgctgaatacgatgctgctgggcggcgacggtgcgataaccgccagcgctaactttgctccggaactctccgtcggcatctaccgcgcctggcgtgaaggcgatctggcgaccgctgcgacgctgaataaaaaactactacaactgcccgctatttacgccctcgaaacaccgtttgtctcactgatcaaatacagcatgcagtgtgtcgggctgcctgtagagacatattgcttaccaccgattcttgaagcatctgaagaagcaaaagataaagtccacgtgctgcttaccgcgcagggcattttaccagtctga

SEQ ID NO: 77 - DNA, 906 bp, Artificial Sequence; identical to SEQ ID NO: 76
  Codon Optimized E. coli Sequence

SEQ ID NO: 78 - protein, 301 aa, Escherichia coli
MKKFSGIIPPVSSTFHRDGTLDKKAMREVADFLINKGVDGLFYLGTGGEFSQMNTAQRMALAEEAVTIVDGRVPVLIGVGSPSTDEAVKLAQHAQAYGADGIVAINPYYWKVAPRNLDDYYQQIARSVTLPVILYNFPDLTGQDLTPETVTRLALQNENIVGIKDTIDSVGHLRTMINTVKSVRPSFSVFCGYDDHLLNTMLLGGDGAITASANFAPELSVGIYRAWREGDLATAATLNKKLLQLPAIYALETPFVSLIKYSMQCVGLPVETYCLPPILEASEEAKDKVHVLLTAQGILPV

SEQ ID NO: 79 - DNA, 909 bp, Escherichia coli
atgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctga

SEQ ID NO: 80 - DNA, 909 bp, Artificial Sequence; identical to SEQ ID NO: 79
  Codon Optimized E. coli Sequence

SEQ ID NO: 81 - protein, 302 aa, Escherichia coli
MPQSALFTGIIPPVSTIFTADGQLDKPGTAALIDDLIKAGVDGLFFLGSGGEFSQLGAEERKAIARFAIDHVDRRVPVLIGTGGTNARETIELSQHAQQAGADGIVVINPYYWKVSEANLIRYFEQVADSVTLPVMLYNFPALTGQDLTPALVKTLADSRSNIIGIKDTIDSVAHLRSMIHTVKGAHPHFTVLCGYDDHLFNTLLLGGDGAISASGNFAPQVSVNLLKAWRDGDVAKAAGYHQTLLQIPQMYQLDTPFVNVIKEAIVLCGRPVSTHVLPPASPLDEPRKAQLKTLLQQLKLC

SEQ ID NO: 82 - DNA, 957 bp, Unknown
  Scheffersomyces stipitis Sequence
atgccttctattaagttgaactctggttacgacatgccagccgtcggtttcggctgttggaaagtcgacgtcgacacctgttctgaacagatctaccgtgctatcaagaccggttacagattgttcgacggtgccgaagattacgccaacgaaaagttagttggtgccggtgtcaagaaggccattgacgaaggtatcgtcaagcgtgaagatttgttccttacctccaagttgtggaacaactaccaccacccagacaacgtcgaaaaggccttgaacagaaccctttctgacttgcaagttgactacgttgacttgttcttgatccacttcccagtcaccttcaagttcgttccattagaagaaaagtacccaccaggattctactgtggtaagggtgacaacttcgactacgaagatgttccaattttagagacttggaaggctcttgaaaagttggtcaaggccggtaagatcagatctatcggtgtttctaacttcccaggtgctttgctcttggacttgttgagaggtgctaccatcaagccatctgtcttgcaagttgaacaccacccatacttgcaacaaccaagattgatcgaattcgctcaatcccgtggtattgctgtcaccgcttactcttcgttcggtcctcaatctttcgttgaattgaaccaaggtagagctttgaacacttctccattgttcgagaacgaaactatcaaggctatcgctgctaagcacggtaagtctccagctcaagtcttgttgagatggtcatcccaaagaggcattgccatcattccaaagtccaacactgtcccaagattgttggaaaacaaggacgtcaacagcttcgacttggacgaacaagatttcgctgacattgccaagttggacatcaacttgagattcaacgacccatgggactgggacaagattcctatcttcgtctaa

SEQ ID NO: 83 - DNA, 957 bp, Artificial Sequence
  Codon Optimized Scheffersomyces stipitis Sequence
atgccatctatcaagttaaattccggttacgacatgcctgctgttggtttcggttgctggaaggttgatgtcgatacttgttccgagcaaatttaccgtgctatcaagactggttacagattgttcgatggtgctgaagactacgccaacgaaaagttagtcggtgctggtgttaaaaaggctatcgacgaaggtattgttaaaagagaagacttgttcttgacttctaagttgtggaacaactaccaccatcctgataacgtcgaaaaagctttgaaccgtaccttgtccgatttgcaagtcgattacgttgatttgttcttgattcatttcccagttaccttcaagttcgttccattggaagagaagtatccaccaggtttctactgtggtaagggtgataacttcgattacgaagatgtcccaatcttagaaacctggaaggctttagaaaagttggttaaggctggtaagatcagatccatcggtgtttctaacttcccaggtgccttattgttagacttattgagaggtgctaccattaagccttccgttttgcaagttgaacatcatccttacttgcaacaaccaagattgatcgaattcgctcaatctagaggtatcgctgttactgcctactcttccttcggtccacaatctttcgttgagttgaaccaaggtagagctttgaacacctctccattgttcgaaaacgaaactattaaggccattgctgctaagcatggtaagtctccagcccaagttttgttgagatggtcttctcaaagaggtatcgctattatcccaaagtctaatactgtcccaagattgttggaaaacaaggacgttaactcctttgatttggatgaacaagactttgctgacatcgctaaattggacatcaacttgagattcaacgacccatgggactgggacaagattccaatttttgtttaa

SEQ ID NO: 84 - protein, 318 aa, Unknown
  Scheffersomyces stipitis Sequence
MPSIKLNSGYDMPAVGFGCWKVDVDTCSEQIYRAIKTGYRLFDGAEDYANEKLVGAGVKKAIDEGIVKREDLFLTSKLWNNYHHPDNVEKALNRTLSDLQVDYVDLFLIHFPVTFKFVPLEEKYPPGFYCGKGDNFDYEDVPILETWKALEKLVKAGKIRSIGVSNFPGALLLDLLRGATIKPSVLQVEHHPYLQQPRLIEFAQSRGIAVTAYSSFGPQSFVELNQGRALNTSPLFENETIKAIAAKHGKSPAQVLLRWSSQRGIAIIPKSNTVPRLLENKDVNSFDLDEQDFADIAKLDINLRFNDPWDWDKIPIFV

SEQ ID NO: 85 - DNA, 984 bp, Saccharomyces cerevisiae; identical to SEQ ID NO: 16

SEQ ID NO: 86 - DNA, 984 bp, Artificial Sequence; identical to SEQ ID NO: 16
  Codon Optimized Saccharomyces cerevisiae Sequence

SEQ ID NO: 87 - protein, 327 aa, Saccharomyces cerevisiae; identical to SEQ ID NO: 17

SEQ ID NO: 88 - DNA, 1092 bp, Unknown
  Scheffersomyces stipitis Sequence
atgactgctaacccttccttggtgttgaacaagatcgacgacatttcgttcgaaacttacgatgccccagaaatctctgaacctaccgatgtcctcgtccaggtcaagaaaaccggtatctgtggttccgacatccacttctacgcccatggtagaatcggtaacttcgttttgaccaagccaatggtcttgggtcacgaatccgccggtactgttgtccaggttggtaagggtgtcacctctcttaaggttggtgacaacgtcgctatcgaaccaggtattccatccagattctccgacgaatacaagagcggtcactacaacttgtgtcctcacatggccttcgccgctactcctaactccaaggaaggcgaaccaaacccaccaggtaccttatgtaagtacttcaagtcgccagaagacttcttggtcaagttgccagaccacgtcagcttggaactcggtgctcttgttgagccattgtctgttggtgtccacgcctctaagttgggttccgttgctttcggcgactacgttgccgtctttggtgctggtcctgttggtcttttggctgctgctgtcgccaagaccttcggtgctaagggtgtcatcgtcgttgacattttcgacaacaagttgaagatggccaaggacattggtgctgctactcacaccttcaactccaagaccggtggttctgaagaattgatcaaggctttcggtggtaacgtgccaaacgtcgttttggaatgtactggtgctgaaccttgtatcaagttgggtgttgacgccattgccccaggtggtcgtttcgttcaagtcggtaacgctgctggtccagtcagcttcccaatcaccgttttcgccatgaaggaattgactttgttcggttctttcagatacggattcaacgactacaagactgctgttggaatctttgacactaactaccaaaacggtagagaaaatgctccaattgactttgaacaattgatcacccacagatacaagttcaaggacgctattgaagcctacgacttggtcagagccggtaagggtgctgtcaagtgtctcattgacggccctgagtaa

SEQ ID NO: 89 - DNA, 1092 bp, Artificial Sequence
  Codon Optimized Scheffersomyces stipitis
atgactgctaacccttccttggtgttgaacaagatcgacgacatttcgttcgaaacttacgatgccccagaaatctctgaacctaccgatgtcctcgtccaggtcaagaaaaccggtatctgtggttccgacatccacttctacgcccatggtagaatcggtaacttcgttttgaccaagccaatggtcttgggtcacgaatccgccggtactgttgtccaggttggtaagggtgtcacctctcttaaggttggtgacaacgtcgctatcgaaccaggtattccatccagattctccgacgaatacaagagcggtcactacaacttgtgtcctcacatggccttcgccgctactcctaactccaaggaaggcgaaccaaacccaccaggtaccttatgtaagtacttcaagtcgccagaagatttcttggtcaagttgccagaccacgtcagcttggaactcggtgctcttgttgagccattgtctgttggtgtccacgcctctaagttgggttccgttgctttcggcgactacgttgccgtctttggagcaggtcctgttggtcttttggctgctgctgtcgccaagaccttcggtgctaagggtgtcatcgtcgttgacattttcgacaacaagttgaagatggccaaggacattggagctgctactcacaccttcaactccaagaccggtggttctgaagaattgatcaaggctttcggtggtaacgtgccaaacgtcgttttggaatgtacaggtgcagaaccttgtatcaagttgggtgttgacgccattgccccaggtggtcgtttcgttcaagtcggtaacgctgctggtccagtcagcttcccaatcaccgttttcgccatgaaggaattgactttgttcggttctttcagatacggattcaacgactacaagactgctgttggaatctttgacactaactaccaaaacggtagagaaaatgctccaattgactttgaacaattgatcacccacagatacaagttcaaggacgctattgaagcctacgacttggtcagagccggtaagggtgctgtcaagtgtctcattgacggccctgagtaa

SEQ ID NO: 90 - protein, 363 aa, Unknown
  Scheffersomyces stipitis Sequence
MTANPSLVLNKIDDISFETYDAPEISEPTDVLVQVKKTGICGSDIHFYAHGRIGNFVLTKPMVLGHESAGTVVQVGKGVTSLKVGDNVAIEPGIPSRFSDEYKSGHYNLCPHMAFAATPNSKEGEPNPPGTLCKYFKSPEDFLVKLPDHVSLELGALVEPLSVGVHASKLGSVAFGDYVAVFGAGPVGLLAAAVAKTFGAKGVIVVDIFDNKLKMAKDIGAATHTFNSKTGGSEELIKAFGGNVPNVVLECTGAEPCIKLGVDAIAPGGRFVQVGNAAGPVSFPITVFAMKELTLFGSFRYGFNDYKTAVGIFDTNYQNGRENAPIDFEQLITHRYKFKDAIEAYDLVRAGKGAVKCLIDGPE

SEQ ID NO: 91 - DNA, 1092 bp, Unknown
  Trichoderma reesei Sequence
atggcgactcaaacgatcaacaaggatgcgatcagcaacctctccttcgtcctcaacaagcccggcgacgtgacctttgaggagcggccgaagccgaccatcacggaccccaacgacgtcctcgtcgccgtcaactacacgggcatctgcggctccgacgtgcactactgggtgcacggcgccatcgggcacttcgtcgtcaaggacccgatggtgctgggccacgagtcggccggcaccgtcgtcgaggtcggcccggccgtcaagagcctcaagcccggcgaccgcgtcgccctcgagcccggctacccgtgccggcggtgctccttctgccgcgccggcaaatacaacctgtgcccggacatggtcttcgccgccacgccgccgtaccacggcaccctgacgggcctgtgggcggcgcccgccgacttctgctacaagctgccggacggcgtgtcgctgcaggagggcgcgctgatcgagccgctggccgtggccgtccacattgtcaagcaggcccgcgtccagccgggccagtccgtcgtcgtcatgggcgccggccccgtcggcctgctgtgcgccgccgtggccaaggcgtacggcgcctccaccattgtcagcgtcgacatcgtgcagtccaagctcgactttgcgcgcggcttctgctcgacgcacacgtacgtctcgcagcgcatctcggctgaggacaacgcaaaggccatcaaggagctggcgggcctgcccggcggcgccgacgtcgtgattgacgccagcggcgcggagccgtcgatccagacgagcattcacgtcgtccgcatgggcggcacgtacgtccagggcggcatgggcaagagcgacatcacgttccccatcatggccatgtgcctcaaggaggtgacggtccggggctcgttccgctacggcgccggcgactacgagctggcggtcgagctggtccggacggggcgggtggacgtcaagaagctgattacgggcaccgtcagcttcaagcaggcggaggaggcgttccaaaaggtcaagtctggggaggccatcaagattctgattgccgggcccaacgagaaggtgtaa

SEQ ID NO: 92 - protein, 363 aa, Unknown
  Trichoderma reesei Sequence
MATQTINKDAISNLSFVLNKPGDVTFEERPKPTITDPNDVLVAVNYTGICGSDVHYWVHGAIGHFVVKDPMVLGHESAGTVVEVGPAVKSLKPGDRVALEPGYPCRRCSFCRAGKYNLCPDMVFAATPPYHGTLTGLWAAPADFCYKLPDGVSLQEGALIEPLAVAVHIVKQARVQPGQSVVVMGAGPVGLLCAAVAKAYGASTIVSVDIVQSKLDFARGFCSTHTYVSQRISAEDNAKAIKELAGLPGGADVVIDASGAEPSIQTSIHVVRMGGTYVQGGMGKSDITFPIMAMCLKEVTVRGSFRYGAGDYELAVELVRTGRVDVKKLITGTVSFKQAEEAFQKVKSGEAIKILIAGPNEKV

SEQ ID NO: 93 - DNA, 1314 bp, Unknown
  Pyromyces sp. Sequence
atggctaaggaatatttcccacaaattcaaaagattaagttcgaaggtaaggattctaagaatccattagccttccactactacgatgctgaaaaggaagtcatgggtaagaaaatgaaggattggttacgtttcgccatggcctggtggcacactctttgcgccgaaggtgctgaccaattcggtggaggtacaaagtctttcccatggaacgaaggtactgatgctattgaaattgccaagcaaaaggttgatgctggtttcgaaatcatgcaaaagcttggtattccatactactgtttccacgatgttgatcttgtttccgaaggtaactctattgaagaatacgaatccaaccttaaggctgtcgttgcttacctcaaggaaaagcaaaaggaaaccggtattaagcttctctggagtactgctaacgtcttcggtcacaagcgttacatgaacggtgcctccactaacccagactttgatgttgtcgcccgtgctattgttcaaattaagaacgccatagacgccggtattgaacttggtgctgaaaactacgtcttctggggtggtcgtgaaggttacatgagtctccttaacactgaccaaaagcgtgaaaaggaacacatggccactatgcttaccatggctcgtgactacgctcgttccaagggattcaagggtactttcctcattgaaccaaagccaatggaaccaaccaagcaccaatacgatgttgacactgaaaccgctattggtttccttaaggcccacaacttagacaaggacttcaaggtcaacattgaagttaaccacgctactcttgctggtcacactttcgaacacgaacttgcctgtgctgttgatgctggtatgctcggttccattgatgctaaccgtggtgactaccaaaacggttgggatactgatcaattcccaattgatcaatacgaactcgtccaagcttggatggaaatcatccgtggtggtggtttcgttactggtggtaccaacttcgatgccaagactcgtcgtaactctactgacctcgaagacatcatcattgcccacgtttctggtatggatgctatggctcgtgctcttgaaaacgctgccaagctcctccaagaatctccatacaccaagatgaagaaggaacgttacgcttccttcgacagtggtattggtaaggactttgaagatggtaagctcaccctcgaacaagtttacgaatacggtaagaagaacggtgaaccaaagcaaacttctggtaagcaagaactctacgaagctattgttgccatgtaccaataa

SEQ ID NO: 94 - DNA, 1314 bp, Unknown
  Codon Optimized Pyromyces sp. Sequence
atggccaaggaatacttcccacaaatccaaaagattaaattcgaaggtaaagattccaagaacccattggcttttcactactacgatgctgagaaggaagttatgggtaagaagatgaaggattggttgagattcgctatggcttggtggcacactttgtgcgctgaaggtgctgaccaattcggtggtggtactaagtctttcccatggaacgaaggtactgatgctattgaaatcgctaagcaaaaagtcgatgctggttttgagattatgcaaaaattgggtatcccatactactgtttccacgacgtcgacttggtttctgaaggtaattctatcgaagaatacgaatctaatttgaaggctgttgtcgcttacttaaaagaaaagcaaaaggagactggtattaagttgttgtggtccaccgctaacgtctttggtcataaaagatacatgaacggtgcttccaccaacccagacttcgatgtcgtcgccagagctatcgttcaaattaaaaacgccatcgacgctggtattgaattgggtgctgaaaattacgtcttttggggtggtcgtgaaggttacatgtctttgttgaacactgaccaaaagagagaaaaagaacacatggccactatgttgaccatggccagagattacgccagatctaagggtttcaagggtaccttcttaattgaaccaaaacctatggaaccaactaagcaccaatacgacgttgacactgaaactgctatcggttttttgaaggctcacaacttggataaggattttaaagtcaacattgaagttaaccatgctactttggctggtcacacttttgaacatgaattggcctgtgctgttgatgctggtatgttgggttctatcgatgctaatagaggtgactatcaaaacggttgggacactgatcaattcccaatcgatcaatatgaattagttcaagcttggatggaaattatcagaggtggtggtttcgttactggtggtactaacttcgatgctaagaccagaagaaactctactgatttggaagatattatcattgcccacgtttccggtatggatgccatggccagagctttggaaaacgccgccaagttattgcaagagtccccatacaccaagatgaaaaaggaacgttacgcttctttcgactctggtatcggtaaagacttcgaagatggtaagttgaccttggaacaagtttacgaatacggtaagaagaacggtgaacctaaacaaacctctggtaaacaagaattgtatgaagctattgttgccatgtaccaataa

SEQ ID NO: 95 - protein, 437 aa, Unknown
  Pyromyces sp. Sequence
MAKEYFPQIQKIKFEGKDSKNPLAFHYYDAEKEVMGKKMKDWLRFAMAWWHTLCAEGADQFGGGTKSFPWNEGTDAIEIAKQKVDAGFEIMQKLGIPYYCFHDVDLVSEGNSIEEYESNLKAVVAYLKEKQKETGIKLLWSTANVFGHKRYMNGASTNPDFDVVARAIVQIKNAIDAGIELGAENYVFWGGREGYMSLLNTDQKREKEHMATMLTMARDYARSKGFKGTFLIEPKPMEPTKHQYDVDTETAIGFLKAHNLDKDFKVNIEVNHATLAGHTFEHELACAVDAGMLGSIDANRGDYQNGWDTDQFPIDQYELVQAWMEIIRGGGFVTGGTNFDAKTRRNSTDLEDIIIAHVSGMDAMARALENAAKLLQESPYTKMKKERYASFDSGIGKDFEDGKLTLEQVYEYGKKNGEPKQTSGKQELYEAIVAMYQ

SEQ ID NO: 96 - DNA, 657 bp, Clostridium acetobutylicum
atgaactctaaaataattagatttgaaaatttaaggtcattctttaaagatgggatgacaattatgattggaggttttttaaactgtggcactccaaccaaattaattgattttttagttaatttaaatataaagaatttaacgattataagtaatgatacatgttatcctaatacaggtattggtaagttaatatcaaataatcaagtaaaaaagcttattgcttcatatataggcagcaacccagatactggcaaaaaactttttaataatgaacttgaagtagagctctctccccaaggaactctagtggaaagaatacgtgcaggcggatctggcttaggtggtgtactaactaaaacaggtttaggaactttgattgaaaaaggaaagaaaaaaatatctataaatggaacggaatatttgttagagctacctcttacagccgatgtagcattaattaaaggtagtattgtagatgaggccggaaacaccttctataaaggtactactaaaaactttaatccctatatggcaatggcagctaaaaccgtaatagttgaagctgaaaatttagttagctgtgaaaaactagaaaaggaaaaagcaatgacccccggagttcttataaattatatagtaaaggagcctgcataa

SEQ ID NO: 97 - protein, 218 aa, Clostridium acetobutylicum
MNSKIIRFENLRSFFKDGMTIMIGGFLNCGTPTKLIDFLVNLNIKNLTIISNDTCYPNTGIGKLISNNQVKKLIASYIGSNPDTGKKLFNNELEVELSPQGTLVERIRAGGSGLGGVLTKTGLGTLIEKGKKKISINGTEYLLELPLTADVALIKGSIVDEAGNTFYKGTTKNFNPYMAMAAKTVIVEAENLVSCEKLEKEKAMTPGVLINYIVKEPA

SEQ ID NO: 98 - DNA, 660 bp, Clostridium acetobutylicum
atgattaatgataaaaacctagcgaaagaaataatagccaaaagagttgcaagagaattaaaaaatggtcaacttgtaaacttaggtgtaggtcttcctaccatggttgcagattatataccaaaaaatttcaaaattactttccaatcagaaaacggaatagttggaatgggcgctagtcctaaaataaatgaggcagataaagatgtagtaaatgcaggaggagactatacaacagtacttcctgacggcacatttttcgatagctcagtttcgttttcactaatccgtggtggtcacgtagatgttactgttttaggggctctccaggtagatgaaaagggtaatatagccaattggattgttcctggaaaaatgctctctggtatgggtggagctatggatttagtaaatggagctaagaaagtaataattgcaatgagacatacaaataaaggtcaacctaaaattttaaaaaaatgtacacttcccctcacggcaaagtctcaagcaaatctaattgtaacagaacttggagtaattgaggttattaatgatggtttacttctcactgaaattaataaaaacacaaccattgatgaaataaggtctttaactgctgcagatttactcatatccaatgaacttagacccatggct

SEQ ID NO: 99 - protein, 221 aa, Clostridium acetobutylicum
MINDKNLAKEIIAKRVARELKNGQLVNLGVGLPTMVADYIPKNFKITFQSENGIVGMGASPKINEADKDVVNAGGDYTTVLPDGTFFDSSVSFSLIRGGHVDVTVLGALQVDEKGNIANWIVPGKMLSGMGGAMDLVNGAKKVIIAMRHTNKGQPKILKKCTLPLTAKSQANLIVTELGVIEVINDGLLLTEINKNTTIDEIRSLTAADLLISNELRPMAV

SEQ ID NO: 100 - DNA, 651 bp, Escherichia coli; identical to SEQ ID NO: 41

SEQ ID NO: 101 - protein, 216 aa, Escherichia coli; identical to SEQ ID NO: 43

SEQ ID NO: 102 - DNA, 663 bp, Escherichia coli; identical to SEQ ID NO: 44

SEQ ID NO: 103 - protein, 220 aa, Escherichia coli; identical to SEQ ID NO: 46

SEQ ID NO: 104 - DNA, 1563 bp, Mus musculus
atgcctgggtcacttcctttgaatgcagaggcttgctggccaaaagatgtgggaatcgttgcccttgaaatctactttccttctcaatatgtcgatcaagctgagttggaaaaatacgatggtgtagatgctggaaagtataccatcggcctgggccaggccaggatgggcttctgcacggatcgtgaagacatcaactctctttgcctgactgtggttcagaaactgatggagagacatagcctttcctatgattgcattgggcggctagaagttggaacagagacaatcatcgacaaatcgaaatcagtgaagtctaatttgatgcagctgtttgaggagtctgggaatacagatatagaaggaatagatacaaccaatgcatgctatgggggcacagctgcagtcttcaatgccgtgaactgggtcgaatccagctcttgggatggacgatatgctctggtagttgcaggagacattgctatatatgccacaggaaatgccagacctacaggtggagttggagctgtggccctgctaattgggccaaacgctcctctaatttttgaccgagggctccgtgggacacacatgcagcatgcctatgacttttacaagcctgacatgctctccgagtaccctgtggtcgacggaaagctctccatacagtgctacctcagcgccctggaccgctgctattctgtctaccgcaaaaagatccgtgcccagtggcagaaagagggaaaggataaagattttaccctgaatgattttggcttcatgatctttcactcaccatattgtaaactggtgcagaaatctctagctcggatgttcctgaatgactttcttaatgatcaaaacagagataaaaacagtatttacagtggactggaagcctttggggacgttaaattagaagatacttactttgacagagatgtagaaaaggcatttatgaaggctagttctgagctattcaaccagaaaacaaaggcgtctttgcttgtgtctaatcagaatggaaatatgtacacatcctctgtctatggttccctggcttctgtcctggcacagtactcacctcagcagttggcagggaagagggttggagtgttctcttacggttctggcttggctgccacgctgtactcccttaaagtcacacaagacgccacaccaggatctgcccttgataaaataacagcaagtttatgtgaccttaaatcaaggcttgactcgagaacttgtgtggcaccggatgtctttgctgaaaacatgaagctcagagaggacacacatcacttagccaactatattccccagtgttcaatagactcactctttgaaggaacgtggtatctggtcagagtggatgaaaaacacagaaggacttacgcccggcgccccttcacaaatgaccacagtttggatgaaggaatggggctcgtgcatagtaacacagcaacagagcatattccaagccctgctaagaaagtgccaagactccctgcaacctcggccgaatctgaatcagctgtcatcagtaacggggagcactga

SEQ ID NO: 105 - protein, 520 aa, Mus musculus
MPGSLPLNAEACWPKDVGIVALEIYFPSQYVDQAELEKYDGVDAGKYTIGLGQARMGFCTDREDINSLCLTVVQKLMERHSLSYDCIGRLEVGTETIIDKSKSVKSKLMQLFEESGNTDIEGIDTTNACYGGTAAVFNAVNWVESSSWDGRYALVVAGDIAIYATGNARPTGGVGAVALLIGPNAPLIFDRGLRGTHMQHAYDFYKPDMLSEYPVVDGKLSIQCYLSALDRCYSVYRKKIRAQWQKEGKDKDFTLNDFGFMIFHSPYCKLVQKSLARMFLNDFLNDQNRDKNSIYSGLEAFGDVKLEDTYFDRDVEKAFMKASSELFNQKTKASLLVSNQNGNMYTSSVYGSLASVLAQYSPQQLAGKRVGVFSYGSGLAATLYSLKVTQDATPGSALDKITASLCDLKSRLDSRTCVAPDVFAENMKLREDTHHLANYIPQCSIDSLFEGTWYLVRVDEKHRRTYARRPFTNDHSLDEGMGLVHSNTATEHIPSPAKKVPRLPATSAESESAVISNGEH

SEQ ID NO: 106 - DNA, 770 bp, Saccharomyces cerevisiae
atgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggc

SEQ ID NO: 107 - protein, 491 aa, Saccharomyces cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 108 - DNA, 1167 bp, Lactobacillus crispatus
atgcaagtaggtattgatcaaattggactttttacgccagacaagtacgttgatatggtcgatttggcgaacgcaagaaagcaagatccaaataagtttttagttggcattggtcaaagagagatgagtgttgcggatattacgcaagatgcagtttcaatgggaattaatgcgactttaaagtttattgacaagattgataagaataaagtcggtctattaatttttgggactgaaagcagtattgatcaatcaaagtcagcttctttatttgtaaaaacagccttaaagttgaagccagaagtaagaacttttgaagtaaaggaagcttgctttggtttaacggcagccttaatgatggcacgtgattttgttcgggtacatcctgaacaaaccgcaattgtcatcggtagtgatattgctcgctatggtgttaatactgctggtgaggtaacacaaggagccggtagcgtggcaatgctcatcaaagctgacccaagcattttagccctaaataatggtcattcagcttacagcgaagatattaacgacttctggagaccaaattattctcgcaccgctttagttgacggcaagtattcgactcaagtttacttggatttcttcaagaagacctttactgattataagaagcaaaaaggattgaaaacaagcgactttgatgcgattacttaccatttgccatttactaagatggggatgaaggctaacaatattgctattgaggggcaagatcaagcaacaatgatcaagttggagcgtagttttgcggctgctaaacaattatcaagccgagtaggtaatatctacaccgcttcactttatatgagtttacttagtttgctagagaatggtgaattacccgctggctcattaattggcctgttttcatatggttcaggtgcaatggctgagttttatagtggcaagttggttgaaggatatgaaaaacaaattgatcctacagctgatcaagcaatgcttgatcggcggaagaagctgacagttaagcaatatgaagacgtcttcaatacggctttgttagatcctgaggatggcttagaattaactagcgacgatgaagtaggtacttggtattttgctggtactaaggatcatattcgtcaataccgcgtaaaagaataa

SEQ ID NO: 109 - protein, 388 aa, Lactobacillus crispatus
MQVGIDQIGLFTPDKYVDMVDLANARKQDPNKFLVGIGQREMSVADITQDAVSMGINATLKFIDKIDKNKVGLLIFGTESSIDQSKSASLFVKTALKLKPEVRTFEVKEACFGLTAALMMARDFVRVHPEQTAIVIGSDIARYGVNTAGEVTQGAGSVAMLIKADPSILALNNGHSAYSEDINDFWRPNYSRTALVDGKYSTQVYLDFFKKTFTDYKKQKGLKTSDFDAITYHLPFTKMGMKANNIAIEGQDQATMIKLERSFAAAKQLSSRVGNIYTASLYMSLLSLLENGELPAGSLIGLFSYGSGAMAEFYSGKLVEGYEKQIDPTADQAMLDRRKKLTVKQYEDVFNTALLDPEDGLELTSDDEVGTWYFAGTKDHIRQYRVKE

SEQ ID NO: 110 - DNA, 660 bp, Unknown
  Polaromonas naphthalenivorans Sequence
atgaccctgcatttaccttccagagtcaagctcgtcgatgtcggtccccgcgacggcctgcagaacgaaaaatcgcccgttcccgccgccgtgaaaatcgaactcgtgcatcgcctgcaggacgccggtctcacggaaatcgaggtcaccagttacgtttcgcccaaatgggtgccgcagatggctgacaacgccgaagtcatggccggcatccggcgcaagcccggcgtgcgctattcggtgctgacgcccaacatgcagggtctagaggcggcgatgaagccagcgcccgagttgtggcccgacgagatcgtggtgttcggcgcggccagcgaagccttcagccagcgcaacatcaactgctcgattgccgaaagcatcgagcgtttccggccggtggtggctgcggcccgggccaacaatatttatgttcgcggcgccatttcctgcaccgtcggctgcccctacgagggcgagattgcgccggagcgcgtcgaaatggtggcgcgcctgatgaaggacatcggcgtgcagcacatcggcgtggccgacacgattggcgtcggcacgccgctgaaggtgcagcgcgccctggaagcggcgctgaagcattacgacctcgatggcgtgtcgggccatttccatgacacctacggccag

SEQ ID NO: 111 - protein, 308 aa, Unknown
  Polaromonas naphthalenivorans Sequence
MTLHLPSRVKLVDVGPRDGLQNEKSPVPAAVKIELVHRLQDAGLTEIEVTSYVSPKWVPQMADNAEVMAGIRRKPGVRYSVLTPNMQGLEAAMKPAPELWPDEIVVFGAASEAFSQRNINCSIAESIERFRPVVAAARANNIYVRGAISCTVGCPYEGEIAPERVEMVARLMKDIGVQHIGVADTIGVGTPLKVQRALEAALKHYDLDGVSGHFHDTYGQALANTLASLQMGVWQFDTSVAGLGGCPYAKGATGNVATEDVVYLLHGMGIETGIDLDKLIDAGKFISDFLGRQPNSRAATALLNKRMN

SEQ ID NO: 112 - DNA, 770 bp, Thermoplasma acidophilum
atgacctacagatcaataggatcaactgcttatccaacgatcggcgttgttctcctgggcgggatagcaaatcccgtcacgaggacgccgctgcatacctcggcagggatagcatacagtgattcctgcggatcgataagatccgagaccaggatatacgccgatgaggctacgcacatatatttcaatggtacggaatcgacagatgacaatagatccgtgaggcgtgtgcttgatcgttattcaagcgtcttcgaggaggcgttcggtacgaagactgtttcatattcttcacagaacttcggcatactgagcggcagttccgatgctggagcggcatcgataggcgcagctatattgggcctcaaacccgatctggatccgcacgatgttgaaaatgacctcagggcggtctccgaaagcgcaggcaggagcctcttcggcggcttaacaataacttggagcgatggtttccatgcatatacggaaaagattcttgatcctgaggcattctccgggtattcgatcgttgccttcgcgtttgactatcagagaaatccgtccgatgtcatacaccagaatatagtgagaagcgatctctatccggccaggaagaagcatgccgatgaacatgcgcacatgatcaaggagtacgcaaagacaaacgacataaagggcatatttgatctggcccaggaagatacagaggaataccattccatacttcgtggcgtgggcgtgaacgtgataagggagaacatgcagaagct

SEQ ID NO: 113 - protein, 318 aa, Thermoplasma acidophilum
MTYRSIGSTAYPTIGVVLLGGIANPVTRTPLHTSAGIAYSDSCGSIRSETRIYADEATHIYFNGTESTDDNRSVRRVLDRYSSVFEEAFGTKTVSYSSQNFGILSGSSDAGAASIGAAILGLKPDLDPHDVENDLRAVSESAGRSLFGGLTITWSDGFHAYTEKILDPEAFSGYSIVAFAFDYQRNPSDVIHQNIVRSDLYPARKKHADEHAHMIKEYAKTNDIKGIFDLAQEDTEEYHSILRGVGVNVIRENMQKLISYLKLIRKDYWNAYIVTGGSNVYVAVESENADRLFSIENTFGSKKKMLRIVGGAWHRRPE

SEQ ID NO: 114 - DNA, 957 bp, Thermoplasma acidophilum
atgacctacagatcaataggatcaactgcttatccaacgatcggcgttgttctcctgggcgggatagcaaatcccgtcacgaggacgccgctgcatacctcggcagggatagcatacagtgattcctgcggatcgataagatccgagaccaggatatacgccgatgaggctacgcacatatatttcaatggtacggaatcgacagatgacaatagatccgtgaggcgtgtgcttgatcgttattcaagcgtcttcgaggaggcgttcggtacgaagactgtttcatattcttcacagaacttcggcatactgagcggcagttccgatgctggagcggcatcgataggcgcagctatattgggcctcaaacccgatctggatccgcacgatgttgaaaatgacctcagggcggtctccgaaagcgcaggcaggagcctcttcggcggcttaacaataacttggagcgatggtttccatgcatatacggaaaagattcttgatcctgaggcattctccgggtattcgatcgttgccttcgcgtttgactatcagagaaatccgtccgatgtcatacaccagaatatagtgagaagcgatgagtatccggccaggaagaagcatgccgatgaacatgcgcacatgatcaaggagtacgcaaagacaaacgacataaagggcatatttgatctggcccaggaagatacagaggaataccattccatacttcgtggcgtgggcgtgaacgtgataagggagaacatgcagaagctcatcagttacctgaagctgatcaggaaggattactggaatgcctacatcgtgaccggcggaagcaacgtctacgtggctgtagaaagcgagaatgcagataggctgttttcgatcgaaaataccttcggttcaaaaaagaagatgctcaggatagttggcggtgcctggcatagaagaccagagtga

SEQ ID NO: 115 - protein, 318 aa, Thermoplasma acidophilum
MTYRSIGSTAYPTIGVVLLGGIANPVTRTPLHTSAGIAYSDSCGSIRSETRIYADEATHIYFNGTESTDDNRSVRRVLDRYSSVFEEAFGTKTVSYSSQNFGILSGSSDAGAASIGAAILGLKPDLDPHDVENDLRAVSESAGRSLFGGLTITWSDGFHAYTEKILDPEAFSGYSIVAFAFDYQRNPSDVIHQNIVRSDEYPARKKHADEHAHMIKEYAKTNDIKGIFDLAQEDTEEYHSILRGVGVNVIRENMQKLISYLKLIRKDYWNAYIVTGGSNVYVAVESENADRLFSIENTFGSKKKMLRIVGGAWHRRPE

SEQ ID NO: 116 - DNA, 770 bp, Unknown
  Picrophilus torridus Sequence
atggaaaattacaatgttaagacaagggcgttcccaacaataggcataatactgcttggtgggatctcggataaaaagaacaggataccgctgcatacaacggcaggcatagcatatactggtataaacaatgatgtttacactgagacaaagctttatgtatcaaaagatgaaaaatgctatattgatggaaaggaaattgatttaaattcagatagatcaccatcgaaggttattgataaattcaagcatgaaatacttatgagagtaaatcttgatgatgaaaataacctttcaattgattcaaggaactttaatatattaagtggcagctcagattctggggccgctgcactgggagagtgcatagaatcaatttttgaatacaatataaatatatttacatttgaaaacgatcttcagaggatatcagaaagtgttggaagaagcctttacggtggtttaacagtaaactatgccaatggcagggaatcattaacagagccattacttgagcctgaggcatttaataactttacaataattggtgcacattttaacattgatagaaaaccatcaaatgagattcatgaaaatatcataaaacatgaaaattacagggaaagaataaaaagtgctgagagaaaggcgaaaaaacttgaggagctatcaaggaatgcaaacataaagggtatctttgaacttgcagaatccgatacagtggaataccataaaatgctccatgatgttggcgttgacataataaatga

SEQ ID NO: 117 - protein, 324 aa, Unknown
  Picrophilus torridus Sequence
MENYNVKTRAFPTIGIILLGGISDKKNRIPLHTTAGIAYTGINNDVYTETKLYVSKDEKCYIDGKEIDLNSDRSPSKVIDKFKHEILMRVNLDDENNLSIDSRNFNILSGSSDSGAAALGECIESIFEYNINIFTFENDLQRISESVGRSLYGGLTVNYANGRESLTEPLLEPEAFNNFTIIGAHFNIDRKPSNEIHENIIKHENYRERIKSAERKAKKLEELSRNANIKGIFELAESDTVEYHKMLHDVGVDIINDRMENLIERVKEMKNNFWNSYIVTGGPNVFVITEKKDVDKAMEGLNDLCDDIRLLKVAGKPQVISKNF

SEQ ID NO: 118 - DNA, 660 bp, Streptococcus mitis
atggatagagagcctgtaacagtacgttcctacgcaaatattgccattatcaaatactggggaaagaaaaaagaaaaagagatggttcctgctactagcagtatttctctgactttggaaaatatgtacacggagacgaccttgtcatctctaccgacggatgcgacagctgatgcattttatatcaatggtcagttacaaaatgaggcagagcatgtcaagatgagtaagattattgaccgctaccgtccagatggtgatggctttgttcgtatcgatactcaaaacagtatgcctaccgcagcgggcttgtcatcaagttctagtggtttgtctgccttggtcaaggcttgtaatgcttatttcaagcttggtttgaatcggagtcagttggcacaggaggctaagtttgcctcaggctcttcctctcggagtttttatggaccactcggtgcctgggataaggatagcggagagatttacccggtagagacaggcctgaaactagctatgattatgttggtgctagaagacaagaaaaaaccaatctctagccgtgatgggatgaaactttgtgtggaaacttcgacgacctttgacgactgggtgcgtcagtctgagaaggattatcaggatatgctggtttacctcaaggcaaat

SEQ ID NO: 119 - protein, 317 aa, Streptococcus mitis
MDREPVTVRSYANIAIIKYWGKKKEKEMVPATSSISLTLENMYTETTLSSLPTDATADAFYINGQLQNEAEHVKMSKIIDRYRPDGDGFVRIDTQNSMPTAAGLSSSSSGLSALVKACNAYFKLGLNRSQLAQEAKFASGSSSRSFYGPLGAWDKDSGEIYPVETGLKLAMIMLVLEDKKKPISSRDGMKLCVETSTTFDDWVRQSEKDYQDMLVYLKANDFAKVGELTEKNALAMHATTKTASPAFSYLTDASYEAMDFVRQLREQGEACYFTMDAGPNVKVLCQEKDLEHLSEIFGQRYRLIVSKTKDLSQDGCC

SEQ ID NO: 120 - DNA, 948 bp, Streptococcus gordonii
atggatcgaaagcctgtaagtgtcaaatcctatgccaatattgcaattgtcaaatattggggcaagaaagatgcagaaaagatgattccgtctacaagcagtatctcactgacactggaaaatatgtataccgagacgcagctgagtcctttgccggatacagcgactggtgatgagttttatattgacggtcagctgcaaagcccggcagaacatgccaaaatcagtaaaattattgaccgttttcgctctccagaagatggttttgtccgtgttgataccagcaataatatgccaacagcagcagggctgtcttccagctccagcggtctatctgctctggtcaaggcttgcaatgcttattttcagacaggctatcagacggaagaactggctcaactggccaagtttgcttcagggtcctctgctcggtctttctttggtccgctagcggcctgggataaggacagtggagccatctatccagtcaagacggatttgaagctagccatgattatgctggttctgcacgatgagaaaaagcccatttccagccgcgacggtatggagctctgtgctaaaacttccacaattttcccagattggattgcccaatctgccttggattatcaggccatgctaggctatttgcaggacaatgattttgccaaggttggtcaactgacggaagaaaatgcccttcggatgcatgctacaacagaaaaagcttatccgccgttttcttatctgacagaggagtcttatcaggctatggatgctgtcagaaagctacgggagcagggcgagcgttgctactttaccatggatgcggggccaaatgtcaaggtgctctgcttggaggaagatctagaccatttggctgccatatttgagaaggactatcgccttattgtctccaaaacaaaggacttgtcagatgaaagctag

SEQ ID NO: 121 - protein, 315 aa, Streptococcus gordonii
MDRKPVSVKSYANIAIVKYWGKKDAEKMIPSTSSISLTLENMYTETQLSPLPDTATGDEFYIDGQLQSPAEHAKISKIIDRFRSPEDGFVRVDTSNNMPTAAGLSSSSSGLSALVKACNAYFQTGYQTEELAQLAKFASGSSARSFFGPLAAWDKDSGAIYPVKTDLKLAMIMLVLHDEKKPISSRDGMELCAKTSTIFPDWIAQSALDYQAMLGYLQDNDFAKVGQLTEENALRMHATTEKAYPPFSYLTEESYQAMDAVRKLREQGERCYFTMDAGPNVKVLCLEEDLDHLAAIFEKDYRLIVSKTKDLSDES

SEQ ID NO: 122 - DNA, 1476 bp, Saccharomyces cerevisiae
atgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataa

SEQ ID NO: 123 - protein, 491 aa, Saccharomyces cerevisiae; identical to SEQ ID NO: 107

SEQ ID NO: 124 - DNA, 816 bp, Pseudomonas putida
atgagcgatttcagcaccctcgaagtgatccgcgacccgcgcggcttcgccaccctgtggttaagccgtgaggacaagaacaacgccttcaatgcgcagatgatccgcgagctgatcgtggccatcgaccagttggccgaagacgccagcctgcgctttgtgctgctgcgcggccgtggccggcacttcagcgccggtgccgacctggcctggatgcagcagtcggcgcaactggacttcaacaccaacctggatgatgcccacgaactgggcgagctgatgtacgccctgcatcgcctcaaggccccgaccctggccgtggtgcaaggtgcagcctttggcggcgcgctgggcctgatcagctgctgcgacatggccatcggcgccgaagacgcccaactgtgcctgtcggaagtacgcatcggcctggccccggcggtcatcagcccgttcgtggtcaaggccattggcgaacgcgccgcgcgccgctacgccctcaccgccgagcgtttcactggcgtgcgcgcacgcgagctgggcctgctggccgaggtgtacccggccagcgaactggacgaccacgtcgaagcctgggtaagcaacctgctgcagaacagcccgcaagcattgcgcgccaccaaggacttgctgcgcgaagtggacgacggcgaactcagcccggccctgcgccgttactgcgaaaacaccatcgcccgtatccgcgtcagcgccgaaggccaggagggcctgcgcgctttcctggaaaaacgccgccctgcctggcaaaccgttgacaagaaggagccgcgcccatga

SEQ ID NO: 125 - protein, 271 aa, Pseudomonas putida
MSDFSTLEVIRDPRGFATLWLSREDKNNAFNAQMIRELIVAIDQLAEDASLRFVLLRGRGRHFSAGADLAWMQQSAQLDFNTNLDDAHELGELMYALHRLKAPTLAVVQGAAFGGALGLISCCDMAIGAEDAQLCLSEVRIGLAPAVISPFVVKAIGERAARRYALTAERFTGVRARELGLLAEVYPASELDDHVEAWVSNLLQNSPQALRATKDLLREVDDGELSPALRRYCENTIARIRVSAEGQEGLRAFLEKRRPAWQTVDKKEPRP

SEQ ID NO: 126 - DNA, 1608 bp, Pseudomonas aeruginosa
atggccatcctgcacacccagatcaatccacgctccgccgagttcgcggccaacgccgcgaccatgctggaacaggtcaacgccctgcgcaccctcctcggccgcatccacgaaggcggcggtagcgccgcccaggcccggcacagcgcgcgcggcaagctgctggtgcgcgaacgcatcaaccgcctgctcgaccccggctcgccgttcctcgagctttccgccctcgccgcccacgaagtctacggcgaagaggtcgccgccgccggcatcgtcgccgggatcggccgggtcgaaggggtggaatgcatgatcgtcggcaacgatgccacggtgaagggcggcacctactatccgctgaccgtgaagaagcacctgcgggcccaggccatcgccctggagaaccgcctgccatgcatctacctggtggactctggcggcgccaacctgccgcgccaggacgaggtgttccccgaccgcgagcacttcggccggatcttcttcaaccaggccaacatgagtgcccgcggcatcccgcagatcgccgtggtcatgggctcctgcaccgccggcggggcctacgtgccggcgatgtccgacgaaaccgtgatggtgcgcgaacaggccaccatcttcctcgccgggccgccgctggtgaaggccgctaccggcgaggtggtcagcgccgaggaacttggcggcgccgacgtgcactgcaaggtctcaggggtcgccgaccactatgccgaggacgatgaccatgccctggccatcgcccgccgctgcgtcgccaacctcaactggcgcaagcagggccagctgcaatgccgtgcaccgcgcgcgccgctgtaccccgccgaggagctgtacggggtgattcccgccgacagcaagcagccctacgacgtgcgcgaagtgatcgcacggctggtggacggctccgagttcgacgaattcaaggcgctgttcggcaccaccctggtctgcggcttcgcccacctgcacggctatccgatcgccatcctggccaacaacgggatcctcttcgccgaggccgcgcagaaaggcgcgcacttcatcgagttggcctgccagcgtggcatcccgctgctgttcctgcagaacatcaccggtttcatggtcggccagaagtacgaggctggcggcatcgccaagcacggcgccaagctggtgaccgcggtggcctgcgcgcgggtgccgaagttcaccgtgctgatcggcggcagcttcggcgccggcaactacggcatgtgcggacgcgcctacgacccgcgcttcctgtggatgtggccgaacgcgaggatcggcgtgatgggcggcgaacaggccgccggggtgctcgcccaggtcaagcgcgagcaggccgagcgcgccggccagcagctcggcgtcgaagaggaggcgaagatcaaggcgccgatcctcgagcagtacgagcaccagggccatccctactactccagcgcgcgactgtgggacgacggcgtgatcgatccggcgcagacccgcgaggtcctcgccctggcgctttccgccgccctcaacgcccccatcgagccgaccgccttcggcgtgttccgcatgtga

SEQ ID NO: 127 - protein, 535 aa, Pseudomonas aeruginosa
MAILHTQINPRSAEFAANAATMLEQVNALRTLLGRIHEGGGSAAQARHSARGKLLVRERINRLLDPGSPFLELSALAAHEVYGEEVAAAGIVAGIGRVEGVECMIVGNDATVKGGTYYPLTVKKHLRAQAIALENRLPCIYLVDSGGANLPRQDEVFPDREHFGRIFFNQANMSARGIPQIAVVMGSCTAGGAYVPAMSDETVMVREQATIFLAGPPLVKAATGEVVSAEELGGADVHCKVSGVADHYAEDDDHALAIARRCVANLNWRKQGQLQCRAPRAPLYPAEELYGVIPADSKQPYDVREVIARLVDGSEFDEFKALFGTTLVCGFAHLHGYPIAILANNGILFAEAAQKGAHFIELACQRGIPLLFLQNITGFMVGQKYEAGGIAKHGAKLVTAVACARVPKFTVLIGGSFGAGNYGMCGRAYDPRFLWMWPNARIGVMGGEQAAGVLAQVKREQAERAGQQLGVEEEAKIKAPILEQYEHQGHPYYSSARLWDDGVIDPAQTREVLALALSAALNAPIEPTAFGVFRM

SEQ ID NO: 128 - DNA, 1968 bp, Pseudomonas aeruginosa
atgaacccggactaccgcagcatccagcgcctcctggtcgccaaccgcggcgagatcgcctgccgggtgatgcgcagcgcgcgcgccctcggcatcggcagcgtcgccgtgcacagcgacatcgaccgccacgcccgccacgtcgccgaagccgacatcgccgtcgacctgggcggcgccaagcccgccgacagctacctgcgcggcgacaggatcatcgcagctgccctcgccagcggcgcccaggcgatccaccccggctacggcttcctctcggagaacgccgacttcgcccgcgcctgcgaggaagccggcctgctcttcctcggaccgccggcggcggccatcgacgccatgggcagcaagtcggccgccaaggcgctgatggaagaagccggcgtgccgctggtgcccggctatcacggcgaagcccaggacctcgagactttccgccgggaagccgggcgcatcggctacccggtgctgctcaaggccgccgctggcggcggcggcaagggcatgaaggtggtggagcgcgaggccgagctggccgaggccctttcctccgcccagcgcgaggccaaggccgccttcggcgacgcgcgtatgctggtggagaaatacctgctgaagccgcgccacgtggagatccaggtattcgccgaccgccatggccactgcctgtacctcaacgaacgcgactgttcgatccagcgccgccaccagaaggtcgtcgaggaagcccccgcccccggtctcggcgcggaactgcgccgggccatgggcgaggccgcggtacgcgcggcgcaggcgatcggctacgtcggcgccggtaccgtcgaattcctcctcgacgaacgcggccagttcttcttcatggaaatgaacacccgcctgcaggtggaacacccggtcaccgaggccatcaccggcctcgacctggtcgcctggcagatccgcgtcgctcgcggcgaggcgctaccgctgacgcaggaacaggtaccgctgaacggccacgccatcgaagtacggctctatgcggaagaccccgagggcgacttcctccccgccagcggccgcctgatgctataccgcgaagcggccgccggccccggccggcgggtcgacagcggggtacgcgaaggcgacgaggtctcgccgttctacgacccgatgctggccaagctgatcgcctggggcgaaacccgcgaggaagcccgccagcgcctgctggcgatgctggcggaaacctcggtcggcggcctgcgcaccaacctggcgttcctccgccgcatcctcggccatccggcgttcgccgccgccgaactggacaccgggttcatcgcgcgccaccaagacgacctgctgccggcgccgcaagcgctgccggagcatttctggcaagccgccgccgaagcctggctgcagagcgaaccgggccaccgtcgcgacgacgacccgcattcgccgtggagccgcaacgacggctggcgcagcgccctggcgcgggagtccgacctgatgctgcgctgccgcgacgaacgccgctgcgtccgcctgcgccacgccagccccagccagtatcgcctcgacggcgacgacctggtcagccgggtggacggtgtcacccgtcgctcggcggcgttgcgccgcggacgccaattgttcctcgaatgggagggcgaactgctggccatcgaagccgtcgacccgatcgccgaggccgaggccgcccatgcccaccagggcggtttgagcgcgccgatgaacggcagtatcgtgcgggtcctggtcgagcccggccagacggtcgaagccggcgccaccctggtggtgctggaggcgatgaagatggaacacagcatccgcgcgccccacgccggggtagtgaaggcgctgtattgcagcgagggcgaactggtcgaggaaggcacgccgctggtggagctggacgagaaccaggcctga

SEQ ID NO: 129 - protein, 655 aa, Pseudomonas aeruginosa
MNPDYRSIQRLLVANRGEIACRVMRSARALGIGSVAVHSDIDRHARHVAEADIAVDLGGAKPADSYLRGDRIIAAALASGAQAIHPGYGFLSENADFARACEEAGLLFLGPPAAAIDAMGSKSAAKALMEEAGVPLVPGYHGEAQDLETFRREAGRIGYPVLLKAAAGGGGKGMKVVEREAELAEALSSAQREAKAAFGDARMLVEKYLLKPRHVEIQVFADRHGHCLYLNERDCSIQRRHQKVVEEAPAPGLGAELRRAMGEAAVRAAQAIGYVGAGTVEFLLDERGQFFFMEMNTRLQVEHPVTEAITGLDLVAWQIRVARGEALPLTQEQVPLNGHAIEVRLYAEDPEGDFLPASGRLMLYREAAAGPGRRVDSGVREGDEVSPFYDPMLAKLIAWGETREEARQRLLAMLAETSVGGLRTNLAFLRRILGHPAFAAAELDTGFIARHQDDLLPAPQALPEHFWQAAAEAWLQSEPGHRRDDDPHSPWSRNDGWRSALARESDLMLRCRDERRCVRLRHASPSQYRLDGDDLVSRVDGVTRRSAALRRGRQLFLEWEGELLAIEAVDPIAEAEAAHAHQGGLSAPMNGSIVRVLVEPGQTVEAGATLVVLEAMKMEHSIRAPHAGVVKALYCSEGELVEEGTPLVELDENQA

SEQ ID NO: 130 - DNA, 1164 bp, Escherichia coli
atggaacaggttgtcattgtcgatgcaattcgcaccccgatgggccgttcgaagggcggtgcttttcgtaacgtgcgtgcagaagatctctccgctcatttaatgcgtagcctgctggcgcgtaacccggcgctggaagcggcggccctcgacgatatttactggggttgtgtgcagcagacgctggagcagggttttaatatcgcccgtaacgcggcgctgctggcagaagtaccacactctgtcccggcggttaccgttaatcgcttgtgtggttcatccatgcaggcactgcatgacgcagcacgaatgatcatgactggcgatgcgcaggcatgtctggttggcggcgtggagcatatgggccatgtgccgatgagtcacggcgtcgattttcaccccggcctgagccgcaatgtcgccaaagcggcgggcatgatgggcttaacggcagaaatgctggcgcgtatgcacggtatcagccgtgaaatgcaggatgcctttgccgcgcggtcacacgcccgcgcctgggccgccacgcagtcggccgcatttaaaaatgaaatcatcccgaccggtggtcacgatgccgacggcgtcctgaagcagtttaattacgacgaagtgattcgcccggaaaccaccgtggaagccctcgccacgctgcgtccggcgtttgatccagtaaacggtatggtaacggcgggcacatcttctgcactttccgatggcgcagctgccatgctggtgatgagtgaaagccgcgcccatgaattaggtcttaagccgcgcgctcgtgtgcgttcgatggcggtcgttggttgtgacccatcgattatgggttacggcccggttccggcctcgaaactggcgctgaaaaaagcggggctttctgccagcgatatcggcgtgtttgaaatgaacgaagcctttgccgcgcagatcctgccatgtattaaagatctgggactaattgagcagattgacgagaagatcaacctcaacggtggcgcgatcgcgctgggtcatccgctgggttgttccggtgcgcgtatcagcaccacgctgctgaatctgatggaacgcaaagacgttcagtttggtctggcgacgatgtgtatcggtctgggtcagggtattgcgacggtgtttgagcgggtttaa

SEQ ID NO: 131 - protein, 387 aa, Escherichia coli
MEQVVIVDAIRTPMGRSKGGAFRNVRAEDLSAHLMRSLLARNPALEAAALDDIYWGCVQQTLEQGFNIARNAALLAEVPHSVPAVTVNRLCGSSMQALHDAARMIMTGDAQACLVGGVEHMGHVPMSHGVDFHPGLSRNVAKAAGMMGLTAEMLARMHGISREMQDAFAARSHARAWAATQSAAFKNEIIPTGGHDADGVLKQFNYDEVIRPETTVEALATLRPAFDPVNGMVTAGTSSALSDGAAAMLVMSESRAHELGLKPRARVRSMAVVGCDPSIMGYGPVPASKLALKKAGLSASDIGVFEMNEAFAAQILPCIKDLGLIEQIDEKINLNGGAIALGHPLGCSGARISTTLLNLMERKDVQFGLATMCIGLGQGIATVFERV

SEQ ID NO: 132 - DNA, 2190 bp, Escherichia coli
atgctttacaaaggcgacaccctgtaccttgactggctggaagatggcattgccgaactggtatttgatgccccaggttcagttaataaactcgacactgcgaccgtcgccagcctcggcgaggccatcggcgtgctggaacagcaatcagatctaaaagggctgctgctgcgttcgaacaaagcagcctttatcgtcggtgctgatatcaccgaatttttgtccctgttcctcgttcctgaagaacagttaagtcagtggctgcactttgccaatagcgtgtttaatcgcctggaagatctgccggtgccgaccattgctgccgtcaatggctatgcgctgggcggtggctgcgaatgcgtgctggcgaccgattatcgtctggcgacgccggatctgcgcatcggtctgccggaaaccaaactgggcatcatgcctggctttggcggttctgtacgtatgccacgtatgctgggcgctgacagtgcgctggaaatcattgccgccggtaaagatgtcggcgcggatcaggcgctgaaaatcggtctggtggatggcgtagtcaaagcagaaaaactggttgaaggcgcaaaggcggttttacgccaggccattaacggcgacctcgactggaaagcaaaacgtcagccgaagctggaaccactaaaactgagcaagattgaagccaccatgagcttcaccatcgctaaagggatggtcgcacaaacagcggggaaacattatccggcccccatcaccgcagtaaaaaccattgaagctgcggcccgttttggtcgtgaagaagccttaaacctggaaaacaaaagttttgtcccgctggcgcataccaacgaagcccgcgcactggtcggcattttccttaacgatcaatatgtaaaaggcaaagcgaagaaactcaccaaagacgttgaaaccccgaaacaggccgcggtgctgggtgcaggcattatgggcggcggcatcgcttaccagtctgcgtggaaaggcgtgccggttgtcatgaaagatatcaacgacaagtcgttaaccctcggcatgaccgaagccgcgaaactgctgaacaagcagcttgagcgcggcaagatcgatggtctgaaactggctggcgtgatctccacaatccacccaacgctcgactacgccggatttgaccgcgtggatattgtggtagaagcggttgttgaaaacccgaaagtgaaaaaagccgtactggcagaaaccgaacaaaaagtacgccaggataccgtgctggcgtctaacacttcaaccattcctatcagcgaactggccaacgcgctggaacgcccggaaaacttctgcgggatgcacttctttaacccggtccaccgaatgccgttggtagaaattattcgcggcgagaaaagctccgacgaaaccatcgcgaaagttgtcgcctgggcgagcaagatgggcaagacgccgattgtggttaacgactgccccggcttctttgttaaccgcgtgctgttcccgtatttcgccggtttcagccagctgctgcgcgacggcgcggatttccgcaagatcgacaaagtgatggaaaaacagtttggctggccgatgggcccggcatatctgctggacgttgtgggcattgataccgcgcatcacgctcaggctgtcatggcagcaggcttcccgcagcggatgcagaaagattaccgcgatgccatcgacgcgctgtttgatgccaaccgctttggtcagaagaacggcctcggtttctggcgttataaagaagacagcaaaggtaagccgaagaaagaagaagacgccgccgttgaagacctgctggcagaagtgagccagccgaagcgcgatttcagcgaagaagagattatcgcccgcatgatgatcccgatggtcaacgaagtggtgcgctgtctggaggaaggcattatcgccactccggcggaagcggatatggcgctggtctacggcctgggcttccctccgttccacggcggcgcgttccgctggctggacaccctcggtagcgcaaaatacctcgatatggcacagcaatatcagcacctcggcccgctgtatgaagtgccggaaggtctgcgtaataaagcgcgtcataacgaaccgtactatcctccggttgagccagcccgtccggttggcgacctgaaaacggcttaa

SEQ ID NO: 133 - protein, 729 aa, Escherichia coli
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLVEGAKAVLRQAINGDLDWKAKRQPKLEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 134 - DNA, 861 bp, Escherichia coli
atgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 135 - protein, 286 aa, Escherichia coli
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 136 - DNA, 1056 bp, Clostridium beijerinckii
atgaaaggttttgcaatgctaggtattaataagttaggatggatcgaaaaagaaaggccagttgcgggttcatatgatgctattgtacgcccattagcagtatctccgtgtacatcagatatacatactgtttttgagggagctcttggagataggaagaatatgattttagggcatgaagctgtaggtgaagttgttgaagtaggaagtgaagtgaaggattttaaacctggtgacagagttatagttccttgtacaactccagattggagatctttggaagttcaagctggttttcaacagcactcaaacggtatgctcgcaggatggaaattttcaaatttcaaggatggagtttttggtgaatattttcatgtaaatgatgcggatatgaatcttgcgattctacctaaagacatgccattagaaaatgctgttatgataacagatatgatgactactggatttcatggagcagaacttgcagatattcaaatgggttcaagtgttgtggtaattggcattggagctgttggcttaatgggaatagcaggtgctaaattacgtggagcaggtagaataattggagtggggagcaggccgatttgtgttgaggctgcaaaattttatggagcaacagatattctaaattataaaaatggtcatatagttgatcaagttatgaaattaacgaatggaaaaggcgttgaccgcgtaattatggcaggcggtggttctgaaacattatcccaagcagtatctatggttaaaccaggaggaataatttctaatataaattatcatggaagtggagatgctttactaataccacgtgtagaatggggatgtggaatggctcacaagactataaaaggaggtctttgtcctgggggacgtttgagagcagaaatgttaagagatatggtagtatataatcgtgttgatctaagtaaattagttacacatgtatatcatggatttgatcacatagaagaagcactgttattaatgaaagacaagccaaaagacttaattaaagcagtagttatattataa

SEQ ID NO: 137 - DNA, 1056 bp, Clostridium beijerinckii
atgaaagggtttgccatgttaggtatcaataaactgggctggattgaaaaagagcgcccggtggcgggttcatacgatgcaattgttcgtccgctggccgtcagtccgtgcaccagcgacatccatacagtctttgaaggtgccctgggtgatcggaaaaacatgattctgggccatgaagccgtaggcgaagtagtggaagtgggcagcgaggtaaaggatttcaaaccgggtgatcgcgtaattgttccttgcacgaccccagattggcgctcactggaagttcaggctggttttcagcagcatagtaacggtatgttagcaggctggaagtttagcaattttaaagacggggtgttcggggagtattttcatgtcaacgatgcggacatgaatctggctattttacctaaagatatgccgctggagaacgcagtgatgattaccgacatgatgacgacaggctttcacggtgcagaactggctgacatccaaatgggctccagtgtggtggttatcggtattggtgcggtcgggctgatgggtatcgcgggcgcgaaattacggggcgctggtcgcatcatcggtgtcggcagccgtccaatttgcgttgaagcagctaaattctatggtgccacggacattctgaactataaaaatggtcacatcgtcgatcaggtgatgaaactgaccaatggcaaaggtgtggaccgcgtgatcatggcgggcggcggctcagagactttatctcaagcggtgtctatggttaaacctgggggcatcatttctaatattaactatcatggctccggcgacgcattactgatcccgcgtgttgaatggggctgtgggatggcccacaaaaccattaaaggggggttatgtccgggtggtcgcctgcgtgccgaaatgctgcgtgacatggtggtttacaaccgtgtggatctgtccaaactggtaactcacgtataccacggtttcgatcacattgaagaggcgctgctgctgatgaaggataagccaaaggatctgattaaggcggttgttatcctgtaa

SEQ ID NO: 138 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFQQHSNGMLAGWKFSNFKDGVFGEYFHVNDADMNLAILPKDMPLENAVMITDMMTTGFHGAELADIQMGSSVVVIGIGAVGLMGIAGAKLRGAGRIIGVGSRPICVEAAKFYGATDILNYKNGHIVDQVMKLTNGKGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 139 - DNA, 2580 bp, Unknown
  Clostridium carboxidivorans Sequence
atgaaggtaactaatgttgaagaactgatgaaaaaaatgcaggaagtgcaaaatgctcaaaaaaaatttgggagttttactcaggaacaagtagatgaaattttcaggcaagcagcactagcagctaacagtgccagaatagatctagctaaaatggcagtggaagaaactaaaatgggaattgtagaggataaggttataaaaaatcattttgttgcagaatacatatataataagtataaaaatgaaaaaacttgtgggattttggaagaagatgaaggctttggaatggttaaaattgcagaacctgtaggtgtgattgcagcagtaattccaacaacaaatccaacatctacagcaatatttaaagcattattagctttgaaaacaagaaatggtataattttttcaccacatccaagagcaaaaaagtgtactattgcagcagctaagttagttcttgatgctgcagttaaagcaggtgctcctaaaggaattataggttggatagatgaaccttctattgaactttcacagatagtaatgaaagaagctgatataatccttgcaacaggtggtccaggtatggttaaagcagcttattcttcaggtaaacctgctataggggttggtcctggtaacacacctgctttaattgatgaaagtgctgatattaaaatggcagtaaattcaatacttctttccaaaacttttgataatggtatgatttgtgcttcagagcagtcggtagtagttgtagattcaatatatgaagaagttaagaaagaatttgctcatagaggagcttatattttaagtaaggatgaaacaactaaagttggaaaaatactcttagttaatggtacattaaatgctggtatcgttggtcagagtgcttataaaatagcagaaatggcaggagttaaagttccagaagatgctaaagttcttataggagaagtaaaatcagtggagcattcagaagagccattttcacatgaaaagttatctccagttttagctatgtatagagctaaaaattttgatgaagctcttttaaaagctggaagattagttgaactcggtggaatgggtcatacatctgtattatatgtaaatgcaataactgaaaaagtaaaagtagaaaaatttagagaaactatgaagactggtagaacattaataaatatgccttcagcacaaggtgctataggagacatatataactttaaactagctccttcattaacattaggttgtggttcatggggaggaaactccgtatcagaaaatgttggacctaaacacttattaaatataaaaagtgttgctgagaggagagaaaatatgctttggtttagagttcctgaaaaggtttattttaaatatggtagtcttggagttgcattaaaagaattagatattttggataagaaaaaagtatttatagtaacagataaagttctttatcaattaggttatatagatagagttacaaagattcttgaagaattgaaaatttcatataaaatatttacagatgtagaaccagatccaaccctagctacagctaaaaaaggtgcagaagaattgttatcatttaatccagatactattatagcagttggtggtggttcagcaatggatgctgctaagattatgtgggtaatgtatgaacatccggaagtaagatttgaagatttagctatgagatttatggatataagaaagagagtatatacttttcctaagatgggtgaaaaagcaatgatgatttctgttgcaacatcagcaggaacaggatcagaagtaacaccttttgcagtaattactgatgaaaaaacaggagctaaatatccattagctgattatgaattaactccaaatatggctataattgatgctgaacttatgatgggtatgccaaaaggattaacagcagcttcaggaatagatgcactaactcatgcaatagaagcttatgtatcaataatggcttcagaatatactaatggattagcgttagaagcaataagattgatatttaagtatttaccaatagcttacagtgaaggaacaacaagtataaaggcaagagaaaaaatggcgcatgcttcaacaatagctggtatggcatttgctaatgcatttttaggagtatgtcattcaatggcacataaattaggatcaactcatcacgtaccacatggcattgccaatgcactacttataaatgaagttataaaatttaatgcagtagaaaatccaagaaaacaagctgcatttccacaatataagtatccaaatataaaaaagagatatgctagaatagcagattaccttaacttaggtgggtcaacagacgatgaaaaagtacaattattaataaatgctatagatgaattaaaagctaagataaatattccagaaagtattaaagaagcaggagtaacagaagaaaaattttatgctactttagataaaatgtcagaattagcttttgatgatcaatgtacaggtgcaaaccctagatatccattaataagtgaaataaaacaaatgtatgtaaatgcattttaa

SEQ ID NO: 140 - protein, 859 aa, Unknown
  Clostridium carboxidivorans Sequence
MKVTNVEELMKKMQEVQNAQKKFGSFTQEQVDEIFRQAALAANSARIDLAKMAVEETKMGIVEDKVIKNHFVAEYIYNKYKNEKTCGILEEDEGFGMVKIAEPVGVIAAVIPTTNPTSTAIFKALLALKTRNGIIFSPHPRAKKCTIAAAKLVLDAAVKAGAPKGIIGWIDEPSIELSQIVMKEADIILATGGPGMVKAAYSSGKPAIGVGPGNTPALIDESADIKMAVNSILLSKTFDNGMICASEQSVVVVDSIYEEVKKEFAHRGAYILSKDETTKVGKILLVNGTLNAGIVGQSAYKIAEMAGVKVPEDAKVLIGEVKSVEHSEEPFSHEKLSPVLAMYRAKNFDEALLKAGRLVELGGMGHTSVLYVNAITEKVKVEKFRETMKTGRTLINMPSAQGAIGDIYNFKLAPSLTLGCGSWGGNSVSENVGPKHLLNIKSVAERRENMLWFRVPEKVYFKYGSLGVALKELDILDKKKVFIVTDKVLYQLGYIDRVTKILEELKISYKIFTDVEPDPTLATAKKGAEELLSFNPDTIIAVGGGSAMDAAKIMWVMYEHPEVRFEDLAMRFMDIRKRVYTFPKMGEKAMMISVATSAGTGSEVTPFAVITDEKTGAKYPLADYELTPNMAIIDAELMMGMPKGLTAASGIDALTHAIEAYVSIMASEYTNGLALEAIRLIFKYLPIAYSEGTTSIKAREKMAHASTIAGMAFANAFLGVCHSMAHKLGSTHHVPHGIANALLINEVIKFNAVENPRKQAAFPQYKYPNIKKRYARIADYLNLGGSTDDEKVQLLINAIDELKAKINIPESIKEAGVTEEKFYATLDKMSELAFDDQCTGANPRYPLISEIKQMYVNAF

SEQ ID NO: 141 - DNA, 1401 bp, Escherichia coli
atgccacattcctacgattacgatgccatagtaataggttccggccccggcggcgaaggcgctgcaatgggcctggttaagcaaggtgcgcgcgtcgcagttatcgagcgttatcaaaatgttggcggcggttgcacccactggggcaccatcccgtcgaaagctctccgtcacgccgtcagccgcattatagaattcaatcaaaacccactttacagcgaccattcccgactgctccgctcttcttttgccgatatccttaaccatgccgataacgtgattaatcaacaaacgcgcatgcgtcagggattttacgaacgtaatcactgtgaaatattgcagggaaacgctcgctttgttgacgagcatacgttggcgctggattgcccggacggcagcgttgaaacactaaccgctgaaaaatttgttattgcctgcggctctcgtccatatcatccaacagatgttgatttcacccatccacgcatttacgacagcgactcaattctcagcatgcaccacgaaccgcgccatgtacttatctatggtgctggagtgatcggctgtgaatatgcgtcgatcttccgcggtatggatgtaaaagtggatctgatcaacacccgcgatcgcctgctggcatttctcgatcaagagatgtcagattctctctcctatcacttctggaacagtggcgtagtgattcgtcacaacgaagagtacgagaagatcgaaggctgtgacgatggtgtgatcatgcatctgaagtcgggtaaaaaactgaaagctgactgcctgctctatgccaacggtcgcaccggtaataccgattcgctggcgttacagaacattgggctagaaactgacagccgcggacagctgaaggtcaacagcatgtatcagaccgcacagccacacgtttacgcggtgggcgacgtgattggttatccgagcctggcgtcggcggcctatgaccaggggcgcattgccgcgcaggcgctggtaaaaggcgaagccaccgcacatctgattgaagatatccctaccggtatttacaccatcccggaaatcagctctgtgggcaaaaccgaacagcagctgaccgcaatgaaagtgccatatgaagtgggccgcgcccagtttaaacatctggcacgcgcacaaatcgtcggcatgaacgtgggcacgctgaaaattttgttccatcgggaaacaaaagagattctgggtattcactgctttggcgagcgcgctgccgaaattattcatatcggtcaggcgattatggaacagaaaggtggcggcaacactattgagtacttcgtcaacaccacctttaactacccgacgatggcggaagcctatcgggtagctgcgttaaacggtttaaaccgcctgttttaa

SEQ ID NO: 142 - protein, 466 aa, Escherichia coli
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIEGCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 143 - DNA, 1323 bp, Escherichia coli
atgcaagcctattttgaccagctcgatcgcgttcgttatgaaggctcaaaatcctcaaacccgttagcattccgtcactacaatcccgacgaactggtgttgggtaagcgtatggaagagcacttgcgttttgccgcctgctactggcacaccttctgctggaacggggcggatatgtttggtgtgggggcgtttaatcgtccgtggcagcagcctggtgaggcactggcgttggcgaagcgtaaagcagatgtcgcatttgagtttttccacaagttacatgtgccattttattgcttccacgatgtggatgtttcccctgagggcgcgtcgttaaaagagtacatcaataattttgcgcaaatggttgatgtcctggcaggcaagcaagaagagagcggcgtgaagctgctgtggggaacggccaactgctttacaaaccctcgctacggcgcgggtgcggcgacgaacccagatcctgaagtcttcagctgggcggcaacgcaagttgttacagcgatggaagcaacccataaattgggcggtgaaaactatgtcctgtggggcggtcgtgaaggttacgaaacgctgttaaataccgacttgcgtcaggagcgtgaacaactgggccgctttatgcagatggtggttgagcataaacataaaatcggtttccagggcacgttgcttatcgaaccgaaaccgcaagaaccgaccaaacatcaatatgattacgatgccgcgacggtctatggcttcctgaaacagtttggtctggaaaaagagattaaactgaacattgaagctaaccacgcgacgctggcaggtcactctttccatcatgaaatagccaccgccattgcgcttggcctgttcggttctgtcgacgccaaccgtggcgatgcgcaactgggctgggacaccgaccagttcccgaacagtgtggaagagaatgcgctggtgatgtatgaaattctcaaagcaggcggtttcaccaccggtggtctgaacttcgatgccaaagtacgtcgtcaaagtactgataaatatgatctgttttacggtcatatcggcgcgatggatacgatggcactggcgctgaaaattgcagcgcgcatgattgaagatggcgagctggataaacgcatcgcgcagcgttattccggctggaatagcgaattgggccagcaaatcctgaaaggccaaatgtcactggcagatttagccaaatatgctcaggaacatcatttgtctccggtgcatcagagtggtcgccaggaacaactggaaaatctggtaaaccattatctgttcgacaaataa

SEQ ID NO: 144 - protein, 440 aa, Escherichia coli
MQAYFDQLDRVRYEGSKSSNPLAFRHYNPDELVLGKRMEEHLRFAACYWHTFCWNGADMFGVGAFNRPWQQPGEALALAKRKADVAFEFFHKLHVPFYCFHDVDVSPEGASLKEYINNFAQMVDVLAGKQEESGVKLLWGTANCFTNPRYGAGAATNPDPEVFSWAATQVVTAMEATHKLGGENYVLWGGREGYETLLNTDLRQEREQLGRFMQMVVEHKHKIGFQGTLLIEPKPQEPTKHQYDYDAATVYGFLKQFGLEKEIKLNIEANHATLAGHSFHHEIATAIALGLFGSVDANRGDAQLGWDTDQFPNSVEENALVMYEILKAGGFTTGGLNFDAKVRRQSTDKYDLFYGHIGAMDTMALALKIAARMIEDGELDKRIAQRYSGWNSELGQQILKGQMSLADLAKYAQEHHLSPVHQSGRQEQLENLVNHYLFDK

SEQ ID NO: 145 - DNA, 1455 bp, Escherichia coli
atgtatatcgggatagatcttggcacctcgggcgtaaaagttattttgctcaacgagcagggtgaggtggttgctgcgcaaacggaaaagctgaccgtttcgcgcccgcatccactctggtcggaacaagacccggaacagtggtggcaggcaactgatcgcgcaatgaaagctctgggcgatcagcattctctgcaggacgttaaagcattgggtattgccggccagatgcacggagcaaccttgctggatgctcagcaacgggtgttacgccctgccattttgtggaacgacgggcgctgtgcgcaagagtgcactttgctggaagcgcgagttccgcaatcgcgggtgattaccggcaacctgatgatgcccggatttactgcgcctaaattgctatgggttcagcggcatgagccggagatattccgtcaaatcgacaaagtattattaccgaaagattacttgcgtctgcgtatgacgggggagtttgccagcgatatgtctgacgcagctggcaccatgtggctggatgtcgcaaagcgtgactggagtgacgtcatgctgcaggcttgcgacttatctcgtgaccagatgcccgcattatacgaaggcagcgaaattactggtgctttgttacctgaagttgcgaaagcgtggggtatggcgacggtgccagttgtcgcaggcggtggcgacaatgcagctggtgcagttggtgtgggaatggttgatgctaatcaggcaatgttatcgctggggacgtcgggggtctattttgctgtcagcgaagggttcttaagcaagccagaaagcgccgtacatagcttttgccatgcgctaccgcaacgttggcatttaatgtctgtgatgctgagtgcagcgtcgtgtctggattgggccgcgaaattaaccggcctgagcaatgtcccagctttaatcgctgcagctcaacaggctgatgaaagtgccgagccagtttggtttctgccttatctttccggcgagcgtacgccacacaataatccccaggcgaagggggttttctttggtttgactcatcaacatggccccaatgaactggcgcgagcagtgctggaaggcgtgggttatgcgctggcagatggcatggatgtcgtgcatgcctgcggtattaaaccgcaaagtgttacgttgattgggggcggggcgcgtagtgagtactggcgtcagatgctggcggatatcagcggtcagcagctcgattaccgtacggggggggatgtggggccagcactgggcgcagcaaggctggcgcagatcgcggcgaatccagagaaatcgctcattgaattgttgccgcaactaccgttagaacagtcgcatctaccagatgcgcagcgttatgccgcttatcagccacgacgagaaacgttccgtcgcctctatcagcaacttctgccattaatggcgtaa

SEQ ID NO: 146 - protein, 484 aa, Escherichia coli
MYIGIDLGTSGVKVILLNEQGEVVAAQTEKLTVSRPHPLWSEQDPEQWWQATDRAMKALGDQHSLQDVKALGIAGQMHGATLLDAQQRVLRPAILWNDGRCAQECTLLEARVPQSRVITGNLMMPGFTAPKLLWVQRHEPEIFRQIDKVLLPKDYLRLRMTGEFASDMSDAAGTMWLDVAKRDWSDVMLQACDLSRDQMPALYEGSEITGALLPEVAKAWGMATVPVVAGGGDNAAGAVGVGMVDANQAMLSLGTSGVYFAVSEGFLSKPESAVHSFCHALPQRWHLMSVMLSAASCLDWAAKLTGLSNVPALIAAAQQADESAEPVWFLPYLSGERTPHNNPQAKGVFFGLTHQHGPNELARAVLEGVGYALADGMDVVHACGIKPQSVTLIGGGARSEYWRQMLADISGQQLDYRTGGDVGPALGAARLAQIAANPEKSLIELLPQLPLEQSHLPDAQRYAAYQPRRETFRRLYQQLLPLMA

SEQ ID NO: 147 - DNA, 1992 bp, Escherichia coli
atgtcctcacgtaaagagcttgccaatgctattcgtgcgctgagcatggacgcagtacagaaagccaaatccggtcacccgggtgcccctatgggtatggctgacattgccgaagtcctgtggcgtgatttcctgaaacacaacccgcagaatccgtcctgggctgaccgtgaccgcttcgtgctgtccaacggccacggctccatgctgatctacagcctgctgcacctcaccggttacgatctgccgatggaagaactgaaaaacttccgtcagctgcactctaaaactccgggtcacccggaagtgggttacaccgctggtgtggaaaccaccaccggtccgctgggtcagggtattgccaacgcagtcggtatggcgattgcagaaaaaacgctggcggcgcagtttaaccgtccgggccacgacattgtcgaccactacacctacgccttcatgggcgacggctgcatgatggaaggcatctcccacgaagtttgctctctggcgggtacgctgaagctgggtaaactgattgcattctacgatgacaacggtatttctatcgatggtcacgttgaaggctggttcaccgacgacaccgcaatgcgtttcgaagcttacggctggcacgttattcgcgacatcgacggtcatgacgcggcatctatcaaacgcgcagtagaagaagcgcgcgcagtgactgacaaaccttccctgctgatgtgcaaaaccatcatcggtttcggttccccgaacaaagccggtacccacgactcccacggtgcgccgctgggcgacgctgaaattgccctgacccgcgaacaactgggctggaaatatgcgccgttcgaaatcccgtctgaaatctatgctcagtgggatgcgaaagaagcaggccaggcgaaagaatccgcatggaacgagaaattcgctgcttacgcgaaagcttatccgcaggaagccgctgaatttacccgccgtatgaaaggcgaaatgccgtctgacttcgacgctaaagcgaaagagttcatcgctaaactgcaggctaatccggcgaaaatcgccagccgtaaagcgtctcagaatgctatcgaagcgttcggtccgctgttgccggaattcctcggcggttctgctgacctggcgccgtctaacctgaccctgtggtctggttctaaagcaatcaacgaagatgctgcgggtaactacatccactacggtgttcgcgagttcggtatgaccgcgattgctaacggtatctccctgcacggtggcttcctgccgtacacctccaccttcctgatgttcgtggaatacgcacgtaacgccgtacgtatggctgcgctgatgaaacagcgtcaggtgatggtttacacccacgactccatcggtctgggcgaagacggcccgactcaccagccggttgagcaggtcgcttctctgcgcgtaaccccgaacatgtctacatggcgtccgtgtgaccaggttgaatccgcggtcgcgtggaaatacggtgttgagcgtcaggacggcccgaccgcactgatcctctcccgtcagaacctggcgcagcaggaacgaactgaagagcaactggcaaacatcgcgcgcggtggttatgtgctgaaagactgcgccggtcagccggaactgattttcatcgctaccggttcagaagttgaactggctgttgctgcctacgaaaaactgactgccgaaggcgtgaaagcgcgcgtggtgtccatgccgtctaccgacgcatttgacaagcaggatgctgcttaccgtgaatccgtactgccgaaagcggttactgcacgcgttgctgtagaagcgggtattgctgactactggtacaagtatgttggcctgaacggtgctatcgtcggtatgaccaccttcggtgaatctgctccggcagagctgctgtttgaagagttcggcttcactgttgataacgttgttgcgaaagcaaaagaactgctgtaa

SEQ ID NO: 148 - protein, 663 aa, Escherichia coli
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKELL

SEQ ID NO: 149 - DNA, 2004 bp, Escherichia coli
atgtcccgaaaagaccttgccaatgcgattcgcgcactcagtatggatgcggtacaaaaagccaactctggtcatcccggcgcgccgatgggcatggctgatattgccgaagtgctgtggaacgattttcttaaacataaccctaccgacccaacctggtatgatcgcgaccgctttattctttccaacggtcacgcgtcgatgctgctctacagtttgctacatctgaccggttacgacctgccgctggaagaactgaagaacttccgtcagttgcattcgaaaaccccaggccacccggagattggctatacgccaggcgttgaaaccaccaccggcccgcttggacaaggtttggcgaacgccgtcgggctggcgatagcagagcgtacactggcggcgcagtttaaccagccagaccatgagatcgtcgatcacttcacctatgtgtttatgggcgacggctgcctgatggaaggtatttcccacgaagtctgttcgctggcaggcacgctgggactgggcaagctgattggtttttacgatcacaacggtatttccatcgacggtgaaacagaaggctggtttaccgacgatacggcaaaacgttttgaagcctatcactggcatgtgatccatgaaatcgacggtcacgatccgcaggcggtgaaggaagcgatccttgaagcgcaaagcgtgaaagataagccgtcgctgattatctgccgtacggtgattggctttggttcgccgaataaagcaggtaaggaagaggcgcacggcgcaccactgggggaagaagaagtggcgctggcacggcaaaaactgggctggcaccatccgccatttgagatccctaaagagatttatcacgcctgggatgcccgtgaaaaaggcgaaaaagcgcagcagagctggaatgagaagtttgccgcctataaaaaggctcatccgcaactggcagaagagtttacccgacggatgagcggtggtttaccgaaggactgggagaaaacgactcagaaatatatcaatgagttacaggcaaatccggcgaaaatcgctacccgtaaggcttcgcaaaatacgcttaacgcttacgggccgatgctgcctgagttgctcggcggttcggcggatctggctcccagcaacctgaccatctggaaaggttctgtttcgctgaaggaagatccagcgggcaactacattcactacggggtgcgtgaatttggcatgaccgctatcgccaacggcatcgcgcaccacggcggctttgtgccgtataccgcgacgttcctgatgtttgttgaatacgcccgtaacgccgcgcggatggcggcactgatgaaagcgcggcagattatggtttatacccacgactcaattggcctgggcgaagatggtccgacgcaccaggctgttgagcaactggccagcctgcgcttaacgccaaatttcagcacctggcgaccgtgcgatcaggtggaagcggcggtgggctggaagctggcggttgagcgccacaacggaccgacggcactgatcctctcaaggcagaatctggcccaggtggaacgtacgccggatcaggttaaagagattgctcgtggcggttatgtgctgaaagacagcggcggtaagccagatattattctgattgccaccggttcagagatggaaattaccctgcaagcggcagagaaattagcaggagaaggtcgcaatgtacgcgtagtttccctgccctcgaccgatattttcgacgcccaggatgaggaatatcgggagtcggtgttgccttctaacgttgcggctcgcgtggcggtggaagcaggtattgccgattactggtacaagtatgttggtctgaaaggggcaattgtcgggatgacgggttacggggaatctgctccggcggataagctgttcccgttctttggctttaccgccgagaatattgtggcaaaagcgcataaggtgctgggagtgaaaggtgcctga

SEQ ID NO: 150 - protein, 667 aa, Escherichia coli
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLAAQFNQPDHEIVDHFTYVFMGDGCLMEGISHEVCSLAGTLGLGKLIGFYDHNGISIDGETEGWFTDDTAKRFEAYHWHVIHEIDGHDPQAVKEAILEAQSVKDKPSLIICRTVIGFGSPNKAGKEEAHGAPLGEEEVALARQKLGWHHPPFEIPKEIYHAWDAREKGEKAQQSWNEKFAAYKKAHPQLAEEFTRRMSGGLPKDWEKTTQKYINELQANPAKIATRKASQNTLNAYGPMLPELLGGSADLAPSNLTIWKGSVSLKEDPAGNYIHYGVREFGMTAIANGIAHHGGFVPYTATFLMFVEYARNAARMAALMKARQIMVYTHDSIGLGEDGPTHQAVEQLASLRLTPNFSTWRPCDQVEAAVGWKLAVERHNGPTALILSRQNLAQVERTPDQVKEIARGGYVLKDSGGKPDIILIATGSEMEITLQAAEKLAGEGRNVRVVSLPSTDIFDAQDEEYRESVLPSNVAARVAVEAGIADYWYKYVGLKGAIVGMTGYGESAPADKLFPFFGFTAENIVAKAHKVLGVKGA

SEQ ID NO: 151 - DNA, 951 bp, Escherichia coli
atgaacgagttagacggcatcaaacagttcaccactgtcgtggcagacagcggcgatattgagtccattcgccattatcatccccaggatgccaccaccaatccttcgctgttactcaaagctgccggattatcacaatatgagcatttaatagacgatgctatcgcctggggtaaaaaaaatggcaagacccaggaacaacaggtggtcgcagcgtgtgacaaactggcggtcaatttcggtgctgaaatcctcaaaatcgtacccggtcgcgtgtcaacagaagttgatgcacgcctctcttttgataaagaaaagagtattgagaaggcgcgccatctggtggacttgtatcagcaacaaggcgttgagaaatcacgcattctgatcaagctggcttcgacctgggaaggaattcgcgcggcagaagagctggaaaaagaaggtattaactgcaacctgacgctgctgttttcttttgcacaggcacgggcctgtgcggaagcaggcgtttttctgatttcgccgtttgtcgggcgtatttatgactggtatcaggcacgcaagccgatggacccgtatgtggtggaagaagatccgggcgttaaatcggtgcgcaatatctacgactactataagcaacaccactatgaaaccattgtgatgggcgcgagcttccgtcgcaccgaacaaatcctcgccttaaccggctgcgatcgactgactatcgcaccgaatttactgaaggagctgcaggaaaaagtttcgccagtggtacgtaaattaatcccaccttctcagacgttcccacgcccagctcccatgagcgaagcggagttccgttgggagcacaatcaggatgcgatggcggtagaaaaactgtctgaaggcattcgtctgttcgccgttgatcaacgcaaactggaagatcttcttgccgccaaactataa

SEQ ID NO: 152 - protein, 316 aa, Escherichia coli
MNELDGIKQFTTVVADSGDIESIRHYHPQDATTNPSLLLKAAGLSQYEHLIDDAIAWGKKNGKTQEQQVVAACDKLAVNFGAEILKIVPGRVSTEVDARLSFDKEKSIEKARHLVDLYQQQGVEKSRILIKLASTWEGIRAAEELEKEGINCNLTLLFSFAQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 153 - DNA, 954 bp, Escherichia coli
atgacggacaaattgacctcccttcgtcagtacaccaccgtagtggccgacactggggacatcgcggcaatgaagctgtatcaaccgcaggatgccacaaccaacccttctctcattcttaacgcagcgcagattccggaataccgtaagttgattgatgatgctgtcgcctgggcgaaacagcagagcaacgatcgcgcgcagcagatcgtggacgcgaccgacaaactggcagtaaatattggtctggaaatcctgaaactggttccgggccgtatctcaactgaagttgatgcgcgtctttcctatgacaccgaagcgtcaattgcgaaagcaaaacgcctgatcaaactctacaacgatgctggtattagcaacgatcgtattctgatcaaactggcttctacctggcagggtatccgtgctgcagaacagctggaaaaagaaggcatcaactgtaacctgaccctgctgttctccttcgctcaggctcgtgcttgtgcggaagcgggcgtgttcctgatctcgccgtttgttggccgtattcttgactggtacaaagcgaataccgataagaaagagtacgctccggcagaagatccgggcgtggtttctgtatctgaaatctaccagtactacaaagagcacggttatgaaaccgtggttatgggcgcaagcttccgtaacatcggcgaaattctggaactggcaggctgcgaccgtctgaccatcgcaccggcactgctgaaagagctggcggagagcgaaggggctatcgaacgtaaactgtcttacaccggcgaagtgaaagcgcgtccggcgcgtatcactgagtccgagttcctgtggcagcacaaccaggatccaatggcagtagataaactggcggaaggtatccgtaagtttgctattgaccaggaaaaactggaaaaaatgatcggcgatctgctgtaa

SEQ ID NO: 154 - protein, 317 aa, Escherichia coli
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 155 - DNA, 954 bp, Escherichia coli; identical to SEQ ID NO: 153

SEQ ID NO: 156 - protein, 317 aa, Escherichia coli; identical to SEQ ID NO: 154

SEQ ID NO: 157 - DNA, 678 bp, Escherichia coli
atgaaacagtatttgattgccccctcaattctgtcggctgattttgcccgcctgggtgaagataccgcaaaagccctggcagctggcgctgatgtcgtgcattttgacgtcatggataaccactatgttcccaatctgacgattgggccaatggtgctgaaatccttgcgtaactatggcattaccgcccctatcgacgtacacctgatggtgaaacccgtcgatcgcattgtgcctgatttcgctgccgctggtgccagcatcattacctttcatccagaagcctccgagcatgttgaccgcacgctgcaactgattaaagaaaatggctgtaaagcgggtctggtatttaacccggcgacacctctgagctatctggattacgtgatggataagctggatgtgatcctgctgatgtccgtcaaccctggtttcggcggtcagtctttcattcctcaaacactggataaactgcgcgaagtacgtcgccgtatcgacgagtctggctttgacattcgactagaagtggacggtggcgtgaaggtgaacaacattggcgaaatcgctgcggcgggcgcggatatgttcgtcgccggttcggcaatcttcgaccagccagactacaaaaaagtcattgatgaaatgcgcagtgaactggcaaaggtaagtcatgaataa

SEQ ID NO: 158 - protein, 225 aa, Escherichia coli
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAIFDQPDYKKVIDEMRSELAKVSHE

SEQ ID NO: 159 - DNA, 1416 bp, Escherichia coli
gtgaaacaaagcactattgcactggcactcttaccgttactgtttacccctgtgacaaaagcccggacaccagaaatgcctgttctggaaaaccgggctgctcagggcgatattactgcacccggcggtgctcgccgtttaacgggtgatcagactgccgctctgcgtgattctcttagcgataaacctgcaaaaaatattattttgctgattggcgatgggatgggggactcggaaattactgccgcacgtaattatgccgaaggtgcgggcggcttttttaaaggtatagatgccttaccgcttaccgggcaatacactcactatgcgctgaataaaaaaaccggcaaaccggactacgtcaccgactcggctgcatcagcaaccgcctggtcaaccggtgtcaaaacctataacggcgcgctgggcgtcgatattcacgaaaaagatcacccaacgattctggaaatggcaaaagccgcaggtctggcgaccggtaacgtttctaccgcagagttgcaggatgccacgcccgctgcgctggtggcacatgtgacctcgcgcaaatgctacggtccgagcgcgaccagtgaaaaatgtccgggtaacgctctggaaaaaggcggaaaaggatcgattaccgaacagctgcttaacgctcgtgccgacgttacgcttggcggcggcgcaaaaacctttgctgaaacggcaaccgctggtgaatggcagggaaaaacgctgcgtgaacaggcacaggcgcgtggttatcagttggtgagcgatgctgcctcactgaattcggtgacggaagcgaatcagcaaaaacccctgcttggcctgtttgctgacggcaatatgccagtgcgctggctaggaccgaaagcaacgtaccatggcaatatcgataagcccgcagtcacctgtacgccaaatccgcaacgtaatgacagtgtaccaaccctggcgcagatgaccgacaaagccattgaattgttgagtaaaaatgagaaaggctttttcctgcaagttgaaggtgcgtcaatcgataaacaggatcatgctgcgaatccttgtgggcaaattggcgagacggtcgatctcgatgaagccgtacaacgggcgctggaattcgctaaaaaggagggtaacacgctggtcatagtcaccgctgatcacgcccacgccagccagattgttgcgccggataccaaagctccgggcctcacccaggcgctaaataccaaagatggcgcagtgatggtgatgagttacgggaactccgaagaggattcacaagaacataccggcagtcagttgcgtattgcggcgtatggcccgcatgccgccaatgttgttggactgaccgaccagaccgatctcttctacaccatgaaagccgctctggggctgaaataa

SEQ ID NO: 160 - protein, 471 aa, Escherichia coli
MKQSTIALALLPLLFTPVTKARTPEMPVLENRAAQGDITAPGGARRLTGDQTAALRDSLSDKPAKNIILLIGDGMGDSEITAARNYAEGAGGFFKGIDALPLTGQYTHYALNKKTGKPDYVTDSAASATAWSTGVKTYNGALGVDIHEKDHPTILEMAKAAGLATGNVSTAELQDATPAALVAHVTSRKCYGPSATSEKCPGNALEKGGKGSITEQLLNARADVTLGGGAKTFAETATAGEWQGKTLREQAQARGYQLVSDAASLNSVTEANQQKPLLGLFADGNMPVRWLGPKATYHGNIDKPAVTCTPNPQRNDSVPTLAQMTDKAIELLSKNEKGFFLQVEGASIDKQDHAANPCGQIGETVDLDEAVQRALEFAKKEGNTLVIVTADHAHASQIVAPDTKAPGLTQALNTKDGAVMVMSYGNSEEDSQEHTGSQLRIAAYGPHAANVVGLTDQTDLFYTMKAALGLK

SEQ ID NO: 161 - DNA, 1858 bp, Arabidopsis thaliana
cacgtggcgaagaatagtccccgaatcttcctctgacgaccatttgatacttttttttcttcagtttgttggttttgtcctcttaacaaaatattcttcaaactctctctgttgtttgtttgttgacaaatctctcaaaaccatttgttttgcaatcgcagatccgtttttcttcgggtctcatcacaatgaatggcttctctgatcttaatccttctgagaggtacgctttgtctgatcatcaatgatgcttataataatctcatttatacatgatcttgcctctatatatttgttcatcttagtaatcttcggtctcagcttccattttcgtctcccactatgtttctaggattttgtgttacttttgttagaaaactgcgatttttgtgctagtgtttgtttctccaagatcaatggaactcgttgcctaaaattcctgattatagttacataaacatcaaatggttctaattggtctttgatcttaaacccatttgattatggtatctaaagtttgatccttttgatgcactctcatcgcagtttctcgtgattttaatattattgaactcttttgatttgtggtgaagcaaaccttctctgtcacaactagctccattagaagccattctgtttgatgttgatggaacactctgtgactcagatcccatccaccttattgccttccaagaactgcttcaagaggttccttgctttttttaatgtcattataacttccaaatttacaacaagactttagaaaactgtgaataatatgctatggaaccttgctattactcagtttcaagctctcgtgtcaatcaattttgtttctttctatcattcgcagattggttttaacaatggtgtcccaatcgatgagaaattctttgttgagaacattgctggaaaacacaattctgaaattgctctacttctgttccctgatgatgtttcaagagggttaaaattctgtgatgaaaaggaagctctttaccgcaagtaagctatttttctgtgtttcctccattcttttaatgtcacaaactcttttcaggtctgagttcatttggagtaactttgttttgttcttttttcttgatgattagaattgttgcagagaagataaagccacttgatgggcttataaaactgaccaaatggatcgaagatcgtggattgaaacgagctgcggtaacaaacgctccaaaagaaaacgcagagctcatgatatcgaaacttggtctgactgatttctttcaagcagtgattcttggctctgaatgtgaatttcccaaaccacaccctggaccttacttgaaggctcttgaagtgcttaacgtgtcaaaggagcacacgctagttttcgaagactcgatctctgggataaaagctggagttgcagctggaatgccagtgattggactgactacagggaatccagcaagcctgcttatgcaagcaaaacccgcttttctcatcgagaactatgcggatccaaaactgtgggctgtgttggaagaacttgataacaagtcttaagtctcacttgtttggcttatggaaacccacacatgcatgagcagcctctgaagtttaccttatgtcttagatgatcattgttgaataattcattgggagtttatgacaatgggagctttcaaatatctgattattttgtattgatacatgcacaatgctagatttgtatccaggagatagttgcataaaccaatatactataccctcggatcttagcttattttcattgatatcttgttgttttgtgctgtaaacatatcagcttttgaatacatttggtccatggcgcaaaataagactttttttttttttt

SEQ ID NO: 162 - protein, 244 aa, Arabidopsis thaliana
MNGFSDLNPSESKPSLSQLAPLEAILFDVDGTLCDSDPIHLIAFQELLQEIGFNNGVPIDEKFFVENIAGKHNSEIALLLFPDDVSRGLKFCDEKEALYRKIVAEKIKPLDGLIKLTKWIEDRGLKRAAVTNAPKENAELMISKLGLTDFFQAVILGSECEFPKPHPGPYLKALEVLNVSKEHTLVFEDSISGIKAGVAAGMPVIGLTTGNPASLLMQAKPAFLIENYADPKLWAVLEELDNKS

SEQ ID NO: 163 - DNA, 819 bp, Bacillus subtilis
atgcgtattatggccagtcatgatacgcctgtgtcaccggctggcattctgattgacttggacggtactgtattcagaggaaatgagttgatcgaaggagcaagagaagcgatcaaaacgcttaggagaatgggaaagaaaatcgtctttttaagcaaccgggggaatatctcccgtgccatgtgcagaaaaaaacttcttggcgcggggattgaaacggacgtaaacgacattgttctgtcatcaagcgtgacagcggcttttctgaaaaaacattatcgtttttcaaaggtatgggtgcttggggagcaaggcttggttgacgagctgaggctggccggtgtgcagaacgcgagcgaaccgaaggaagcggattggctcgtgatctcccttcatgaaacgctcacgtacgacgatttaaatcaagcctttcaagcggctgccggcggcgctcgtattatcgctacaaacaaagaccgctcttttccgaacgaagacggaaatgccattgatgtggccggaatgatcggggcaattgagacttctgcacaagcgaagactgaacttgttgtcggaaaaccgtcatggctgatggcggaggctgcctgtacagcaatggggctgtccgcacatgaatgcatgattataggagacagcattgaatctgacattgcgatggggaagctttatggcatgaaaagcgccttagtgctaactggttctgcgaaacagggtgaacagcgtttgtacacgccggattatgtgctggattctattaaggatgtaaccaaattggctgaggaggggattctgatatga

SEQ ID NO: 164 - protein, 272 aa, Bacillus subtilis
MRIMASHDTPVSPAGILIDLDGTVFRGNELIEGAREAIKTLRRMGKKIVFLSNRGNISRAMCRKKLLGAGIETDVNDIVLSSSVTAAFLKKHYRFSKVWVLGEQGLVDELRLAGVQNASEPKEADWLVISLHETLTYDDLNQAFQAAAGGARIIATNKDRSFPNEDGNAIDVAGMIGAIETSAQAKTELVVGKPSWLMAEAACTAMGLSAHECMIIGDSIESDIAMGKLYGMKSALVLTGSAKQGEQRLYTPDYVLDSIKDVTKLAEEGILI

SEQ ID NO: 165 - DNA, 825 bp, Pseudomonas fluorescens
atgagtgacgcagcgattcatcccatccgttttatcctcagtgacgtggacggcaccttgctgcatcccgatcatagcctcagccaacgcaccgccgacgcggtgcgcgccttgcgcgaagccggagtgttgttcagcctggccagcgggcgcccgcccaaggccatgctgcacctgatcgaaacctttgggatcgatgtgccggtggcgggcttcaatggcggtaccttgatcaacccggatggcagcatcctggttgcccatcatctgccggcggaagcggcgctggttaccctggcgctgttttcagcggagccggaggtggaagtgtgggtgtttgccgatggcgactggctgcgccgtgacccgtcagggccgatggagccgcgcgaggcgaatggcctgggctatgggccggtggtggtggagagtttcgagccctacctggaccgggtcgacaagatcgtcgccgcgagtcacaacacgcaattattggtagagctggaggcgcgattgcaacccaaggtgcaggggctggcccaggtgtcgcgttcgcaaccggtgtacttggacgtgaccgcgatgctggccaacaagggcgaggccttgaagaccttggcggcacacctgggtgtgcccatggagcaaacggcggcgattggcgatggtggcaatgacccggcgatgtttcaggtggccgggttgtcgattgccatggggcaggcggaagaaaccgtcaagcgccaggccagtgtggtgacgggcagcaacatcgaagatggcgccgccgaagcaatcgaacggtttattctcgcggcaccttaa

SEQ ID NO: 166 - protein, 274 aa, Pseudomonas fluorescens
MSDAAIHPIRFILSDVDGTLLHPDHSLSQRTADAVRALREAGVLFSLASGRPPKAMLHLIETFGIDVPVAGFNGGTLINPDGSILVAHHLPAEAALVTLALFSAEPEVEVWVFADGDWLRRDPSGPMEPREANGLGYGPVVVESFEPYLDRVDKIVAASHNTQLLVELEARLQPKVQGLAQVSRSQPVYLDVTAMLANKGEALKTLAAHLGVPMEQTAAIGDGGNDPAMFQVAGLSIAMGQAEETVKRQASVVTGSNIEDGAAEAIERFILAAP

SEQ ID NO: 167 - DNA, 651 bp, Escherichia coli
gtgcggtgcaaaggttttctgtttgatcttgatggaacgctggtggattccctgcctgcggtagaacgggcgtggagcaactgggccagacgtcatgggttagcgccggaagaggtgctggctttcattcacggtaaacaggcgatcacctctctgcgccattttatggcgggcaaatccgaggctgatattgccgccgagtttacgcgtctggagcacatcgaggccacggaaaccgaaggtattaccgcgcttccgggggcaatcgccttactcagtcatttgaataaagcaggtattccgtgggccattgtgacttctggctccatgccggtagcgcgagcgcgccataaaatagctgggcttcccgcaccagaggtgtttgtaaccgctgagcgagtgaagcgcggaaaaccagaacctgatgcgtatctgttaggcgcgcagctgctggggcttgcgccgcaggagtgtgtggtggtggaagatgctcccgctggcgtgctttctggcctggcggcgggttgtcatgtcattgcggttaacgctccggcagataccccgcgcctgaatgaggtcgatttggtcctccacagtctggagcaaattactgtgaccaaacagccaaatggcgatgttattattcagtga

SEQ ID NO: 168 - protein, 216 aa, Escherichia coli
MRCKGFLFDLDGTLVDSLPAVERAWSNWARRHGLAPEEVLAFIHGKQAITSLRHFMAGKSEADIAAEFTRLEHIEATETEGITALPGAIALLSHLNKAGIPWAIVTSGSMPVARARHKIAGLPAPEVFVTAERVKRGKPEPDAYLLGAQLLGLAPQECVVVEDAPAGVLSGLAAGCHVIAVNAPADTPRLNEVDLVLHSLEQITVTKQPNGDVIIQ

SEQ ID NO: 169 - DNA, 816 bp, Escherichia coli
atgagcgtaaaagttatcgtcacagacatggacggtacttttcttaacgacgccaaaacgtacaaccaaccacgttttatggcgcaatatcaggaactgaaaaagcgcggcattaagttcgttgttgccagcggtaatcagtattaccagcttatttcattctttcctgagctaaaggatgagatctcttttgtcgcggaaaacggcgcactggtttacgaacatggcaagcagttgttccacggcgaactgacccgacatgaatcgcggattgttattggcgagttgctaaaagataagcaactcaattttgtcgcctgcggtctgcaaagtgcatatgtcagcgaaaatgcccccgaagcatttgtcgcactgatggcaaaacactaccatcgcctgaaacctgtaaaagattatcaggagattgacgacgtactgttcaagttttcgctcaacctgccggatgaacaaatcccgttagtgatcgacaaactgcacgtagcgctcgatggcattatgaaacccgttaccagtggttttggctttatcgacctgattattcccggtctacataaagcaaacggtatttcgcggttactgaaacgctgggatctgtcaccgcaaaatgtggtagcgattggcgacagcggtaacgatgcggagatgctgaaaatggcgcgttattcctttgcgatgggcaatgctgcggaaaacattaaacaaatcgcccgttacgctaccgatgataataatcatgaaggcgcgctgaatgtgattcaggcggtgctggataacacatccccttttaacagctga

SEQ ID NO: 170 - protein, 271 aa, Escherichia coli
MSVKVIVTDMDGTFLNDAKTYNQPRFMAQYQELKKRGIKFVVASGNQYYQLISFFPELKDEISFVAENGALVYEHGKQLFHGELTRHESRIVIGELLKDKQLNFVACGLQSAYVSENAPEAFVALMAKHYHRLKPVKDYQEIDDVLFKFSLNLPDEQIPLVIDKLHVALDGIMKPVTSGFGFIDLIIPGLHKANGISRLLKRWDLSPQNVVAIGDSGNDAEMLKMARYSFAMGNAAENIKQIARYATDDNNHEGALNVIQAVLDNTSPFNS

SEQ ID NO: 171 - DNA, 813 bp, Escherichia coli
atggctattaaactcattgctatcgatatggatggcacccttctgctgcccgatcacaccatttcacccgccgttaaaaatgcgattgccgcagctcgcgcccgtggcgtgaatgtcgtgctaacgacgggtcgcccgtatgcaggtgtgcacaactacctgaaagagctgcatatggaacagccgggcgactactgcattacttataacggcgcgctggtacagaaggccgctgatggtagcaccgtggcgcaaactgctctcagctatgacgactatcgtttcctggaaaaactctctcgcgaagtcggttctcatttccacgccctggaccgcaccacgctgtacaccgccaaccgtgatatcagctactacacggtgcatgaatccttcgttgccaccattccgctggtgttctgcgaagcggagaaaatggaccccaatacccagttcctgaaagtgatgatgattgatgaacccgccatcctcgaccaggctatcgcgcgtattccgcaggaagtgaaagagaaatataccgtgctgaaaagtgcgccgtacttcctcgaaatcctcgataaacgcgttaacaaaggtacgggggtgaaatcactggccgacgtgttaggtattaaaccggaagaaatcatggcgattggcgatcaggaaaacgatatcgcaatgattgaatatgcaggcgtcggtgtggcgatggataacgctattccttcagtgaaagaagtggcgaactttgtcaccaaatctaaccttgaagatggcgtggcgtttgctattgagaagtatgtgctgaattaa

SEQ ID NO: 172 - protein, 270 aa, Escherichia coli
MAIKLIAIDMDGTLLLPDHTISPAVKNAIAAARARGVNVVLTTGRPYAGVHNYLKELHMEQPGDYCITYNGALVQKAADGSTVAQTALSYDDYRFLEKLSREVGSHFHALDRTTLYTANRDISYYTVHESFVATIPLVFCEAEKMDPNTQFLKVMMIDEPAILDQAIARIPQEVKEKYTVLKSAPYFLEILDKRVNKGTGVKSLADVLGIKPEEIMAIGDQENDIAMIEYAGVGVAMDNAIPSVKEVANFVTKSNLEDGVAFAIEKYVLN

SEQ ID NO: 173 - DNA, 867 bp, Plasmodium falciparum
atgcacgaaattgtagataagaatggtaagaaagttcaaaagaataatttgaatgatgaaataaaaataatctttacggatttagatggaacattgttaaatagtgagaataaggtttcagaacagaatttggagagtttaataagagctcaagaaaaaggcataaaggttgttatagcaacaggtagatctatattttctgtagagaatgttataggagagcatgtaaaaaagaatagaataagtttattaccagggatatatatgaatggatgtgtaacatttgatgaaaaaggttcaagggtgatagataggattatgaacaatgacttgaaaatggagatacatgaattttctaaacaaataaatatatcaaaatatgctatatggttttgtttagaaaaaacatattgttttgaaataaatgattgtatacgtgaatatatggaggttgaagcattaaatcctgatgttattgaagataatatgttagaaggtttgacagtatataaagtattattttcattaccagaaaatatattagaaaatacgttaaaattatgtagagagaaattttctcatcgtattaatgtagctaatacttttcaaagttatgttgaattatttcatcaacatactaataaattcgaaggtgtaaaagaaatttgtaaatattataatataagtctaaacaatgcgctagctatgggagatggagaaaatgatattgaaatgttaagtggtttaacacattcagtgggtgtacataatgcttcagaaaaagtaaaaaattcagctgcttatgttggaccttcgaataatgaacatgctatatctcatgtcttgaagacattctgtgacatataa

SEQ ID NO: 174 - protein, 288 aa, Plasmodium falciparum
MHEIVDKNGKKVQKNNLNDEIKIIFTDLDGTLLNSENKVSEQNLESLIRAQEKGIKVVIATGRSIFSVENVIGEHVKKNRISLLPGIYMNGCVTFDEKGSRVIDRIMNNDLKMEIHEFSKQINISKYAIWFCLEKTYCFEINDCIREYMEVEALNPDVIEDNMLEGLTVYKVLFSLPENILENTLKLCREKFSHRINVANTFQSYVELFHQHTNKFEGVKEICKYYNISLNNALAMGDGENDIEMLSGLTHSVGVHNASEKVKNSAAYVGPSNNEHAISHVLKTFCDI

SEQ ID NO: 175 - DNA, 1059 bp, Enterococcus avium
atgagtaaaacaatgaagggtgtttccaagcaggcacccggttatgaccaaatggcatttatcgatttatctgttccagaagcaacagatgacaaggtcttgattaaagtcgcttatacaggtatttgcggatcagatatccatacgtttaaaggtgaatacaaaaatcccactactcccgtcgtcctaggacatgaattttctgggcaggtagttgaagtcggagccaatgtaccaaaggtcaaggttggtgatcgggtaaccagtgagacgaccttttatgtctgcggcgaatgcgattattgcaaggaaaagcagtataatttgtgtccccatcgaaaaggaatcggcacgcagcaaaatggctccatggcgaactatgtgttggctcgagaagaaagcattcatttactgccggatcatttaagctatgaaggtgcggcgatgagcgaaccattagcgtgctgtgtccacgcgatgtatcaaaagagtcacttggaattaaaagacacgatcattatcatgggccctggaccaatcggactgtatcttttgcagattgccaaggaaattggagccttcgtcattatgacggggatcacaaaagatgctcatcgcttagcattagcaaaaaaactaggcgcggatgtgatcgttgatacgatgaaggaagatctagcgaaagtcgtcaatgagatcacggatggctacggtgtcgataaagtgtatgatgcctcaggagcagttcctgctgttaatgctagtctgccattgattcgcaagcaggggcaatttattcaagtaggcttgttcgctaataaaatggtggatttagacactgaatcgatcattcaacgagagatcgaatacatcggcagtcgttcacagaacccttatgactggccgattgcgatccacttattagcgaaaggtgcgatcaatatcgatgagatgattacgaaaaaatacccgttgactgaatggcgggaagcctttgataaagtgatggaaggcaatgaaatcaaggtaatgatcgaatccaatccagaagaattttaa

SEQ ID NO: 176 - protein, 352 aa, Enterococcus avium
MSKTMKGVSKQAPGYDQMAFIDLSVPEATDDKVLIKVAYTGICGSDIHTFKGEYKNPTTPVVLGHEFSGQVVEVGANVPKVKVGDRVTSETTFYVCGECDYCKEKQYNLCPHRKGIGTQQNGSMANYVLAREESIHLLPDHLSYEGAAMSEPLACCVHAMYQKSHLELKDTIIIMGPGPIGLYLLQIAKEIGAFVIMTGITKDAHRLALAKKLGADVIVDTMKEDLAKVVNEITDGYGVDKVYDASGAVPAVNASLPLIRKQGQFIQVGLFANKMVDLDTESIIQREIEYIGSRSQNPYDWPIAIHLLAKGAINIDEMITKKYPLTEWREAFDKVMEGNEIKVMIESNPEEF

SEQ ID NO: 177 - DNA, 846 bp, Candida albicans
atggattccgcatactggtcatacgataacatagtcccaagcttccgtttggatggaaaactagtcatattaaccggtggctctggtggtttggctgccgtggtatcaagagctttattagccaaaggtgccgatgttgcattagtcgatatgaacttggaaagaacacaacaagctgctagagacgtcttacaatggggcgaagagcaaatgaaaggtaaatacgaatcaccaatcggtcaggtgagtgcttggtcatgtaatattggcgatgctgaagctgtcgacttgacattcaaagccatcaacgaacaccacggcaaaatctcaagtgtcttggtcaacactgccggttacgctgaaaacttcccagctgaagagtacccagccaagaacgctgaaaaccttatgaaagttaacgggttggggtcattctacgtttcccaagcttttgctagaccattaatccaaaacaacatgaccggatcgatcattttgatcgggtcaatgtccggtaccatcgtcaacgacccacaaccacaatgcatgtacaacatgtccaaagccggtgtcattcatttagccagatcattggcctgtgaatgggctaaatacaatatcagagtcaacacattgtcgccagggtacatcttaaccccattgacaagaaacgttattagtggacacaccgaaatgaagacagaatgggaatcaaagatcccaatgaagagaatggcagaaccaaaagagtttgttggttctatcttatacttggcctcagaatctgcttcatcatacactactggtcacaacttggtcgttgacgggggttacgagtgctggtaa

SEQ ID NO: 178 - protein, 281 aa, Candida albicans
MDSAYWSYDNIVPSFRLDGKLVILTGGSGGLAAVVSRALLAKGADVALVDMNLERTQQAARDVLQWGEEQMKGKYESPIGQVSAWSCNIGDAEAVDLTFKAINEHHGKISSVLVNTAGYAENFPAEEYPAKNAENLMKVNGLGSFYVSQAFARPLIQNNMTGSIILIGSMSGTIVNDPQPQCMYNMSKAGVIHLARSLACEWAKYNIRVNTLSPGYILTPLTRNVISGHTEMKTEWESKIPMKRMAEPKEFVGSILYLASESASSYTTGHNLVVDGGYECW

SEQ ID NO: 179 - DNA, 849 bp, Candida tropicalis
atggactcctcatcatactggtcatacgacaacattgttccaagttttagattggatggaaaattagtaattatcactggtggttctggtggtttgtccgctgttgtttccagagccttgttagcaaaaggtgctgatattgctttgattgatatgaacttggaaagaacccaacaagccgcaagagatgttttacaatggggtgaagaacaaatgaaaggaaaacacgaatctccaattggtcaagtcagtgcttggtcctgtaacattggtgatgctgaagctgttgaattgacattcaaagccatcaacgaacaccacggtaaagttgccagtgttttgattaacacagctggttatgctgaaaatttccctgctgaagaatacccagccaagaatgccgaaaatatcatgaaggtcaatggtttaggatccttttacgtctcacaagctttcgccagacctttgattcaaaataacatgactggctctattatcttgattggttctatgtctggtaccattgtcaacgatccacaaccacaatgtatgtacaacatgtccaaagctggtgtcattcacttggccagatctttagcatgtgaatgggccaaatacaacatcagagtcaataccttgtccccaggttatattttgactccattgacaagaaatgttattagtggtcacactgaaatgaagacagaatgggaatccaagattccaatgaagagaatggccgagccaaaagaatttgtcggttctattttgtacttggcttctgattctgcctcttcctacactactggtcacaatttggtagtggatggtggttacgaatgttggtaa

SEQ ID NO: 180 - protein, 282 aa, Candida tropicalis
MDSSSYWSYDNIVPSFRLDGKLVIITGGSGGLSAVVSRALLAKGADIALIDMNLERTQQAARDVLQWGEEQMKGKHESPIGQVSAWSCNIGDAEAVELTFKAINEHHGKVASVLINTAGYAENFPAEEYPAKNAENIMKVNGLGSFYVSQAFARPLIQNNMTGSIILIGSMSGTIVNDPQPQCMYNMSKAGVIHLARSLACEWAKYNIRVNTLSPGYILTPLTRNVISGHTEMKTEWESKIPMKRMAEPKEFVGSILYLASDSASSYTTGHNLVVDGGYECW

SEQ ID NO: 181 - DNA, 1158 bp, Unknown
  Scheffersomyces stipitis Sequence
aatttctatagattggtacaaatcatagaatagagaatcccaatagcacaagctcctgatttccttgcattatttgcccgcgctcaagtattttttagactgagtcttccatacttcgtactgatataaacaaatattgcacaaactactactagtgaattactaatagtttccaccaaatacagccactacacactacatatactacaatggactactcatacgctaacgttgttcccaacttcagattggacggaagattggctattattaccggaggttctggtggtttggccgcagtcatttcgcgtgccttgttggcccagggcgctgatgttgctctcattgacatgaacttggaaagaaccaagtccgctgccaaagaagttttgggctggggtgaagagacgttgaagggtgaacacgcttcagccatcggccaagtttccgcctggtcctgcaacattggggatgctgaggcagtagacgctactttcagctccatcaacgaacaccacggcaagatcgctgacttgttgattaacaccgctggatactgtgaaaacttccctgccgaaacgtacccggctactaacgctgaaagcatcatgaaggtgaacggtttgggctcattctacgtttcgcaatcgttcgctagaccattgatccagaacaacttgagaggctctatcatcttgattggctcaatgtctggaacaattgtcaacgacccacaaccccaatgtatgtacaacatgtccaaggctggagtgatccacttggtcagatcgttggcctgcgaatgggccaagtacaacatcagagtcaacaccttatcaccaggctatattttgactcctttaaccagaaacgtgatttctggccacacagagatgaaggaagcctgggaatccaagatccccatgaagagaatggccgaacccaaggaattcgtggggtccatcttatacttggcaagcgagactgcttcttcctacactacgggccacaatttggttgtggacggaggatatgaatgctggtagataccgctcccattttaatgaaacgaccacgatacgacccacagtttaatttcacaagtataaagtttatatgtcgctactgttttatagagaaagccaaaattgacgaaac

SEQ ID NO: 182 - protein, 278 aa, Unknown
  Scheffersomyces stipitis Sequence
MDYSYANVVPNFRLDGRLAIITGGSGGLAAVISRALLAQGADVALIDMNLERTKSAAKEVLGWGEETLKGEHASAIGQVSAWSCNIGDAEAVDATFSSINEHHGKIADLLINTAGYCENFPAETYPATNAESIMKVNGLGSFYVSQSFARPLIQNNLRGSIILIGSMSGTIVNDPQPQCMYNMSKAGVIHLVRSLACEWAKYNIRVNTLSPGYILTPLTRNVISGHTEMKEAWESKIPMKRMAEPKEFVGSILYLASETASSYTTGHNLVVDGGYECW

SEQ ID NO: 183 - DNA, 1482 bp, Pseudomonas fluorescens
atgaaactgaataagcagaacctcacccagctggcgcccgaagtgaaattgccagcctatacgcttgccgacacacgccagggcatcgcccatatcggcgtcggcggcttccatcgcgcgcaccaggcgtattacaccgatgcgctgatgaataccggcgagggcctggactggagcatctgcggcgttggcctgcgcagcgaggaccgcaaggcccgcgatgacctggccggccaggactacctgttcaccctgtacgaactgggcgacaccgacgacaccgaagtgcgcgtgatcggctcgatcagcgacatgctgctggccgaagacagcgcccaggcattgatcgataaactggccagccccgagattcgcatcgtctcgctgaccatcaccgaaggcggctactgcatcgacgacagcaacggcgaattcatggcccacttgccgcagatccagcacgacctggctcatccgtcgtcgccaaaaaccgtgttcggctttatctgcgcggcattgacccagcgccgcgcggccggcatcccggcgtttaccgtgatgtcctgcgataacctgccccacaatggcgctgtcacgcgcaaggcactgctggcgttcgccgccctgcacaacgccgagctgcatgactggatcaaggcccatgtgagcttcccgaacgccatggtcgaccgcatcacgccgatgaccagcaccgcccaccgcctgcaactgcacgatgaacacggcatcgacgatgcctggccagttgtttgcgaaccctttgtgcagtgggtactggaagacaaattcgtcaacggccgcccggcgtgggaaaaggttggcgtgcagttcaccgacgatgtgacaccctatgaagagatgaagatcggcttgctcaacggcagccacctggccctgacctacctgggttttctcaagggctatcggtttgtgcacgagaccatgaacgacccgctgttcgtggcctacatgcgcgcctacatggacctcgacgtcacgccaaacctcgcgccggtaccgggcatcgacctgaccgactacaagcagaccctggtggaccgcttctccaaccaggcgattgccgaccagttggaacgggtgtgttcggatggctcgtcgaagtttcccaagttcaccgtgccgaccatcaaccgcctgattgccgacggccgtgagaccgagcgtgcagcactggtcgtcgcggcctgggccttgtatttgaagggtgtggatgagaatggcgtgagctacacaatccccgatccgcgcgccgagttctgccaggggctggtgagtgacgatgcactgatcagccagcggttgctggcagtggaagagattttcggtacggctattcccaactcgcctgagtttgtggcagcgttcgagcggtgctatgggagcctgcgtgataacggcgtcaccactaccctgaagcacctcctgaagaaaccggtttaa

SEQ ID NO: 184 - protein, 493 aa, Pseudomonas fluorescens
MKLNKQNLTQLAPEVKLPAYTLADTRQGIAHIGVGGFHRAHQAYYTDALMNTGEGLDWSICGVGLRSEDRKARDDLAGQDYLFTLYELGDTDDTEVRVIGSISDMLLAEDSAQALIDKLASPEIRIVSLTITEGGYCIDDSNGEFMAHLPQIQHDLAHPSSPKTVFGFICAALTQRRAAGIPAFTVMSCDNLPHNGAVTRKALLAFAALHNAELHDWIKAHVSFPNAMVDRITPMTSTAHRLQLHDEHGIDDAWPVVCEPFVQWVLEDKFVNGRPAWEKVGVQFTDDVTPYEEMKIGLLNGSHLALTYLGFLKGYRFVHETMNDPLFVAYMRAYMDLDVTPNLAPVPGIDLTDYKQTLVDRFSNQAIADQLERVCSDGSSKFPKFTVPTINRLIADGRETERAALVVAAWALYLKGVDENGVSYTIPDPRAEFCQGLVSDDALISQRLLAVEEIFGTAIPNSPEFVAAFERCYGSLRDNGVTTTLKHLLKKPV

SEQ ID NO: 185 - DNA, 1368 bp, Klebsiella pneumoniae
ttagttaatcagcgtgtaaacggcggcgactttctcgcgcatcagcgccaggaaatccgcgttgttggcgagatcaccaaacagggctttatcacgggcgaagacagccaccggatcctgagcctcgaacatctcatgcaccgcctgcgcatccaggatgccgtcctggtactgatatggcagagttcccttgtgccactgctccataaagacgaagaacagcgccggcagcatggcggtcgcttccgggcggacgccgcgctggtagcactcctgcaaggttggcgcgatcatcgccggaattttcgagaagccgtcggcggcgacgcgctggttggtgtcctggatataggggttggtaaagcgcttaagcaccacatcccggtaggtcggcagatcaatgccgttgtcgccgagacacggaataacgtcctccgtaacgtagcggtcggcaatggcgtagataacatcggtcagcgtgctttcatgaatatactgctggccgattaaggttcccgcccaggcaatgcagctgtgcgacgcgttcaaaatacggattttcgcctcttcatacgggatgaccgactccaccatctccacgccgactgcctccagattcgggcggacatcgcggaagttgttctccactacccactggataaaggtctcccccatcaccggcgctttgtcatcaattccggcttgcgctttgatgcgggccggcagatcggccgccggacgcggggtgatgcggtccaccatggtgttcggacaggtggtattggccgccatccagtcaatcaccgcctgtttgccggtgagctgcaggaactcgaccataccgtcgtggaaacgctcgccgttatggcgcacgttatcgcagttgagcagggtcagcggcccggcgttgtcggccatgcgcttttccaggatccgcgcgagggtgccgtaaatggttttgcactcgccttgcaggtcggcctgcagatcggggttgctggtttccagccgatggcgagtgttcaggtagtaccccccttccgtcacggtaaaggcgataactttggtctgcgggtttgccccttcgttaatcagcggctgtagcccggcctgccacggtagcagtttctggattgaggtgatctcttcatattcgcgctccccttccgggctgacggtctcgaggacgtaacgtcctccctgcgccgccagcgcctggaccacctgctcggcgtcgttgcgaatattccccgccgcgatgcgccagcgattatccccggaagcaatcagacgatgcagataccacgcctgatgcgcgcgatgaaaagaacccagaccgatatgaagccatgtgaattgattgttcat

SEQ ID NO: 186 - protein, 455 aa, Klebsiella pneumoniae
MNNQFTWLHIGLGSFHRAHQAWYLHRLIASGDNRWRIAAGNIRNDAEQVVQALAAQGGRYVLETVSPEGEREYEEITSIQKLLPWQAGLQPLINEGANPQTKVIAFTVTEGGYYLNTRHRLETSNPDLQADLQGECKTIYGTLARILEKRMADNAGPLTLLNCDNVRHNGERFHDGMVEFLQLTGKQAVIDWMAANTTCPNTMVDRITPRPAADLPARIKAQAGIDDKAPVMGETFIQWVVENNFRDVRPNLEAVGVEMVESVIPYEEAKIRILNASHSCIAWAGTLIGQQYIHESTLTDVIYAIADRYVTEDVIPCLGDNGIDLPTYRDVVLKRFTNPYIQDTNQRVAADGFSKIPAMIAPTLQECYQRGVRPEATAMLPALFFVFMEQWHKGTLPYQYQDGILDAQAVHEMFEAQDPVAVFARDKALFGDLANNADFLALMREKVAAVYTLIN

SEQ ID NO: 187 - DNA, 1398 bp, Ralstonia solanacearum
atgacgcggtcgtccctcgcgcgtgcgccagtgctgctgcatattggcgccggatctttccatcgtgcgcaccaggcgtggtatctgcatcgcgtcaacgcggccgtgcctcccggcgagcgctggacgctgacggtcgggaacattcgcgacgacatgcacgcgacactcgccgcgctggccgcgcagcagggtgcctacacgctcgagaccgtcacgccgcaaggcgagcgtgcgtatgagacgatccgctcgatcgcgcgggtgctgccctggtccgccgatcttgccgcgctcatcaatacgggcgccgatcccgcgtgccggatcgtgtcgtttacggtcaccgaaggcgggtattacctcgacgagcacgatcgtctcgatgtcacgcatcccgatctcgcggccgacctgcggggcgcccgctcgacgctatacggcgcattggccgcgttgctcgccgagcgccgccagcgcggagccgggccgctcacgctgcagagttgcgacaatctgcgcagcaacggcgcgcgttttcgcgcgggcatgcgcgcgttcctcgcgctgcgcggcgacgcagcgctcctcgcgtggttcgatgccaacgtatcgtgcccgagcgcgatggtcgaccggatcacgccgcggccgaccgacgacgtccgcacgcgcgtgcacgcggccaccggcgtcgacgaccgctgcccggtcatgggcgaatccttcatccaatgggtgatcgaggacaacttcatcgccggccggccggcatgggagatcgcgggcgcggagatcgtcgccgatgtgcatccgtacgaagaggcgaagatccggatcctgaatgcgacgcacagctgcatcgcctgggcgggcacgctcgcgggactcacctacattcacgaagggatgcgtgatgcggccatttatcgcttcgcctacgactacgtcaccgacgacgtgattccctgcctgacgccgagcccgctggatctcgagcgctatcgggacgtcgtgctcgagcgcttcggcaatccgtacgtgctcgacaccaaccagcgtgtcgccgccgatggcttctcgaaaatccccggcttcatcgcaccgacgctcgccgaatgctttgcgcgcggcgccgatccggtcgcgaccgcggtgttgccggcgctgtttctgggcttccttgaaggttgggcgcgcggcaccttgccctacgtataccaggacggcgtgatggatggcgccgccgcacgcagcatcgtcgaggctccggattccgttgccgcgttctgttcagatcgccaattgtggggttcgcttgcgggccgcgacgcgcttgtccaggcggtgcgtgcgggacgcgcgcgcgttgaagcatggcgagccgcacgccgctga

SEQ ID NO: 188 - protein, 465 aa, Ralstonia solanacearum
MTRSSLARAPVLLHIGAGSFHRAHQAWYLHRVNAAVPPGERWTLTVGNIRDDMHATLAALAAQQGAYTLETVTPQGERAYETIRSIARVLPWSADLAALINTGADPACRIVSFTVTEGGYYLDEHDRLDVTHPDLAADLRGARSTLYGALAALLAERRQRGAGPLTLQSCDNLRSNGARFRAGMRAFLALRGDAALLAWFDANVSCPSAMVDRITPRPTDDVRTRVHAATGVDDRCPVMGESFIQWVIEDNFIAGRPAWEIAGAEIVADVHPYEEAKIRILNATHSCIAWAGTLAGLTYIHEGMRDAAIYRFAYDYVTDDVIPCLTPSPLDLERYRDVVLERFGNPYVLDTNQRVAADGFSKIPGFIAPTLAECFARGADPVATAVLPALFLGFLEGWARGTLPYVYQDGVMDGAAARSIVEAPDSVAAFCSDRQLWGSLAGRDALVQAVRAGRARVEAWRAARR

SEQ ID NO: 189 - DNA, 1185 bp, Bacillus subtilis
atgaatcgtatcgcagctgacgttcagcgtgcttttgaaaacgccggagaaaagacgttgcctataaaagttgaagaaattgttctcggtaagcaagcagctgattcgcttttggattatgtaaaacgaaaaaacaatcaacatattgtccttgtctgcgacgcgaatacacaccgcattgcaggaattgatttagaaaaccgactgaatcaagaaggatttcaggccgagtgcctgatcattccagaaaatgaagccggagatgtgacagctgatgaacgatcgctcattcatgtgctgatccatacgaaacaaccaacggatgtcatgatcgcagtcggttcgggcacgattcatgatatcgtccgctttgcggcgtttcaaagagatttgccgtttatttcttatccgactgctccatctgtagacggttttacatcagccggtgcgccgattattttatacggcacgaaaacaaccattcaaacgaaggccccatctgcgctgttcgctgatctggatctattaaaagcggcaccgcagtcaatggtggcggctggctttggtgacatgctcggtaaaatcacgtctttagcagattgggaaatatcccggcatcttgccggtgagccttattcgcctgcaggagctaagatcgttcaggaggcgcttgctgcctgcattgaacacacagaagacattgcgatgaaaacggaaactggcatacgggttttgatggagtctttacttgtatcggggcttgtcatgctggcattagatcattcccgaccggcatcaggcggcgagcatcatatttcacattggattgaaatggagttaatggagaaaaaacggcctcagattcttcatggggcaaaggtgggctgtgccgctgttttattaactgacacatacagaaagctcgctcaggatgacgggctgaacgaattttcaccaagccgccgggaagccatccaatcggcttatcaaacactcccgagaggagaagtgctggctgattggctgagatcagccggaggccctgcgtattttgacgaaatcggtgtcgggcaggattccgtcaaaaatgccttcagacacgcgcacaccttaagagaccgatgcaccggattaagaatcatcaatgaaaacaaaacgctgatcaaccatggtctatatgaatag

SEQ ID NO: 190 - protein, 394 aa, Bacillus subtilis
MNRIAADVQRAFENAGEKTLPIKVEEIVLGKQAADSLLDYVKRKNNQHIVLVCDANTHRIAGIDLENRLNQEGFQAECLIIPENEAGDVTADERSLIHVLIHTKQPTDVMIAVGSGTIHDIVRFAAFQRDLPFISYPTAPSVDGFTSAGAPIILYGTKTTIQTKAPSALFADLDLLKAAPQSMVAAGFGDMLGKITSLADWEISRHLAGEPYSPAGAKIVQEALAACIEHTEDIAMKTETGIRVLMESLLVSGLVMLALDHSRPASGGEHHISHWIEMELMEKKRPQILHGAKVGCAAVLLTDTYRKLAQDDGLNEFSPSRREAIQSAYQTLPRGEVLADWLRSAGGPAYFDEIGVGQDSVKNAFRHAHTLRDRCTGLRIINENKTLINHGLYE

SEQ ID NO: 191 - DNA, 1059 bp, Aeropyrum pernix
ttgtatacctcgttccacaggatagacctcccgaggactatagtagtcggcggaggcgttctcgacaaggcgggcggctatgtatctggggtggctcagcgaggcagctatgtgctcgtcgtatccggcccaacggtgtcctcgaaatacttcgagaggcttagagccagcctcgaggccgagggccttacagtcggcctgaagataatcagggacgccacggttgagactgctgaggaggtggcccgtgaggctcttgagagcaggatagaggttgtggcgggcctgggaggtgggaagtcgatagacgttgctaagtacgcttcaaaaagggcgggctcggttttcgtcagcatacccaccgtggctagccacgacgggataacatcgccattctcaagcctgaaggggttcgacaagcctatatcgaggcccgctaaggctccggaggcgataattatagatgtggatgtgatagcggaggctcccaggcgctacaacatcgctggcttcggagacctgataggcaagtatactgcagtcctcgactggaggctggcccacaagctcaggctggaatactatggcgaatacgccgccagtctcgccctcctgagcgccaaacatgtgagccagtacgccgaggagatagcgctgggtacgagggagggctatagagtgctgctggaggctctcgtgagcagcggggtgtcgatgtgtatagccggtagcacgaggcctgcaagcggcagtgaacacctcttcgcccacgccctccacatagtcgctaggaacaagcctctccacggcgaggcggttggggtggggactataatgatggcctacctccacggtaagaactggaggaggataaggggcctgctgaagacggtcggcgcccccactaacgccaaggagcttggtgtcgaggatgatgaggttgttgaggccctcactatagcagccaggatcagaccggagaggtacaccatactaggtgaaaaggggctcacgagagaggcggctgaggcgctggcgcgcaagacgggcgttatatag

SEQ ID NO: 192 - protein, 352 aa, Aeropyrum pernix
MYTSFHRIDLPRTIVVGGGVLDKAGGYVSGVAQRGSYVLVVSGPTVSSKYFERLRASLEAEGLTVGLKIIRDATVETAEEVAREALESRIEVVAGLGGGKSIDVAKYASKRAGSVFVSIPTVASHDGITSPFSSLKGFDKPISRPAKAPEAIIIDVDVIAEAPRRYNIAGFGDLIGKYTAVLDWRLAHKLRLEYYGEYAASLALLSAKHVSQYAEEIALGTREGYRVLLEALVSSGVSMCIAGSTRPASGSEHLFAHALHIVARNKPLHGEAVGVGTIMMAYLHGKNWRRIRGLLKTVGAPTNAKELGVEDDEVVEALTIAARIRPERYTILGEKGLTREAAEALARKTGVI

SEQ ID NO: 193 - DNA, 1020 bp, Escherichia coli
atgaaccaacgtaatgcttcaatgactgtgatcggtgccggctcgtacggcaccgctcttgccatcaccctggcaagaaatggccacgaggttgtcctctggggccatgaccctgaacatatcgcaacgcttgaacgcgaccgctgtaacgccgcgtttctccccgatgtgccttttcccgatacgctccatcttgaaagcgatctcgccactgcgctggcagccagccgtaatattctcgtcgtcgtacccagccatgtctttggtgaagtgctgcgccagattaaaccactgatgcgtcctgatgcgcgtctggtgtgggcgaccaaagggctggaagcggaaaccggacgtctgttacaggacgtggcgcgtgaggccttaggcgatcaaattccgctggcggttatctctggcccaacgtttgcgaaagaactggcggcaggtttaccgacagctatttcgctggcctcgaccgatcagacctttgccgatgatctccagcagctgctgcactgcggcaaaagtttccgcgtttacagcaatccggatttcattggcgtgcagcttggcggcgcggtgaaaaacgttattgccattggtgcggggatgtccgacggtatcggttttggtgcgaatgcgcgtacggcgctgatcacccgtgggctggctgaaatgtcgcgtcttggtgcggcgctgggtgccgaccctgccacctttatgggcatggcggggcttggcgatctggtgcttacctgtaccgacaaccagtcgcgtaaccgccgttttggcatgatgctcggtcagggcatggatgtacaaagcgcgcaggagaagattggtcaggtggtggaaggctaccgcaatacgaaagaagtccgcgaactggcgcatcgcttcggcgttgaaatgccaataaccgaggaaatttatcaagtattatattgcggaaaaaacgcgcgcgaggcagcattgactttactaggtcgtgcacgcaaggacgagcgcagcagccactaa

SEQ ID NO: 194 - protein, 339 aa, Escherichia coli
MNQRNASMTVIGAGSYGTALAITLARNGHEVVLWGHDPEHIATLERDRCNAAFLPDVPFPDTLHLESDLATALAASRNILVVVPSHVFGEVLRQIKPLMRPDARLVWATKGLEAETGRLLQDVAREALGDQIPLAVISGPTFAKELAAGLPTAISLASTDQTFADDLQQLLHCGKSFRVYSNPDFIGVQLGGAVKNVIAIGAGMSDGIGFGANARTALITRGLAEMSRLGAALGADPATFMGMAGLGDLVLTCTDNQSRNRRFGMMLGQGMDVQSAQEKIGQVVEGYRNTKEVRELAHRFGVEMPITEEIYQVLYCGKNAREAALTLLGRARKDERSSH

SEQ ID NO: 195 - DNA, 1176 bp, Saccharomyces cerevisiae
atgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 196 - protein, 391 aa, Saccharomyces cerevisiae
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 197 - DNA, 1224 bp, Escherichia coli
atgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagcacacgaaggttctaccggtttcattccggcgggaatggacggcaacgctgaagttatcggcgcgtacgcatgggcgcacgaaatgtcatccggtaaagataccccgtctggtcactgggaaattgccggtgtcccggttctgtttgagtggggatatttctccgatcacgaaaacagcttcccgcaagagctgctggataaactggtcgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggataaactctacgaactgtgcgaaatcgcccgtgaagagctgaccaacggcggctacaatatcggtcgtgttatcgctcgtccgtttatcggcgacaaagccggtaacttccagcgtaccggtaaccgtcacgacctggctgttgagccgccagcaccgaccgtgctgcagaaactggttgatgaaaaacacggccaggtggtttctgtcggtaaaattgcggacatctacgccaactgcggtatcaccaaaaaagtgaaagcgactggcctggacgcgctgtttgacgccaccatcaaagagatgaaagaagcgggtgataacaccatcgtcttcaccaacttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactctggcaaaatattttggtacttctgatatggaatatggcaaagccatgttctga

SEQ ID NO: 198 - protein, 407 aa, Escherichia coli
MKRAFIMVLDSFGIGATEDAERFGDVGADTLGHIAEACAKGEADNGRKGPLNLPNLTRLGLAKAHEGSTGFIPAGMDGNAEVIGAYAWAHEMSSGKDTPSGHWEIAGVPVLFEWGYFSDHENSFPQELLDKLVERANLPGYLGNCHSSGTVILDQLGEEHMKTGKPIFYTSADSVFQIACHEETFGLDKLYELCEIAREELTNGGYNIGRVIARPFIGDKAGNFQRTGNRHDLAVEPPAPTVLQKLVDEKHGQVVSVGKIADIYANCGITKKVKATGLDALFDATIKEMKEAGDNTIVFTNFVDFDSSWGHRRDVAGYAAGLELFDRRLPELMSLLRDDDILILTADHGCDPTWTGTDHTREHIPVLVYGPKVKPGSLGHRETFADIGQTLAKYFGTSDMEYGKAMF

SEQ ID NO: 199 - DNA, 1641 bp, Escherichia coli
atggcaatccacaatcgtgcaggccaacctgcacaacagagtgatttgattaacgtcgcccaactgacggcgcaatattatgtactgaaaccagaagcagggaatgcggagcacgcggtgaaattcggtacttccggtcaccgtggcagtgcagcgcgccacagctttaacgagccgcacattctggcgatcgctcaggcaattgctgaagaacgtgcgaaaaacggcatcactggcccttgctatgtgggtaaagatactcacgccctgtccgaacctgcattcatttccgttctggaagtgctggcagcgaacggcgttgatgtcattgtgcaggaaaacaatggcttcaccccgacgcctgccgtttccaatgccatcctggttcacaataaaaaaggtggcccgctggcagacggtatcgtgattacaccgtcccataacccgccggaagatggtggaatcaaatacaatccgccaaatggtggcccggctgataccaacgtcactaaagtggtggaagacagggccaacgcactgctggccgatggcctgaaaggcgtgaagcgtatctccctcgacgaagcgatggcatccggtcatgtgaaagagcaggatctggtgcagccgttcgtggaaggtctggccgatatcgttgatatggccgcgattcagaaagcgggcctgacgctgggcgttgatccgctgggcggttccggtatcgaatactggaagcgtattggcgagtattacaacctcaacctgactatcgttaacgatcaggtcgatcaaaccttccgctttatgcaccttgataaagacggcgcgatccgtatggactgctcctccgagtgtgcgatggcgggcctgctggcactgcgtgataagttcgatctggcgtttgctaacgacccggattatgaccgtcacggtatcgtcactccggcaggtttgatgaatccgaaccactacctggcggtggcaatcaattacctgttccagcatcgtccgcagtggggcaaagatgttgccgtcggtaaaacgctggtttcatctgcgatgatcgaccgtgtggtcaacgacttgggccgtaaactggtagaagtcccggtaggtttcaaatggtttgtcgatggtctgttcgacggcagcttcggctttggcggcgaagagagtgcaggggcttccttcctgcgtttcgacggcacgccgtggtccaccgacaaagacggcatcatcatgtgtctgctggcggcggaaatcaccgctgtcaccggtaagaacccgcaggaacactacaacgaactggcaaaacgctttggtgcgccgagctacaaccgtttgcaggcagctgcgacttccgcacaaaaagcggcgctgtctaagctgtctccggaaatggtgagcgccagcaccctggcaggtgacccgatcaccgcgcgcctgactgctgctccgggcaacggtgcttctattggcggtctgaaagtgatgactgacaacggctggttcgccgcgcgtccgtcaggcacggaagacgcatataagatctactgcgaaagcttcctcggtgaagaacatcgcaagcagattgagaaagaagcggttgagattgttagcgaagttctgaaaaacgcgtaa

SEQ ID NO: 200 - protein, 546 aa, Escherichia coli
MAIHNRAGQPAQQSDLINVAQLTAQYYVLKPEAGNAEHAVKFGTSGHRGSAARHSFNEPHILAIAQAIAEERAKNGITGPCYVGKDTHALSEPAFISVLEVLAANGVDVIVQENNGFTPTPAVSNAILVHNKKGGPLADGIVITPSHNPPEDGGIKYNPPNGGPADTNVTKVVEDRANALLADGLKGVKRISLDEAMASGHVKEQDLVQPFVEGLADIVDMAAIQKAGLTLGVDPLGGSGIEYWKRIGEYYNLNLTIVNDQVDQTFRFMHLDKDGAIRMDCSSECAMAGLLALRDKFDLAFANDPDYDRHGIVTPAGLMNPNHYLAVAINYLFQHRPQWGKDVAVGKTLVSSAMIDRVVNDLGRKLVEVPVGFKWFVDGLFDGSFGFGGEESAGASFLRFDGTPWSTDKDGIIMCLLAAEITAVTGKNPQEHYNELAKRFGAPSYNRLQAAATSAQKAALSKLSPEMVSASTLAGDPITARLTAAPGNGASIGGLKVMTDNGWFAARPSGTEDAYKIYCESFLGEEHRKQIEKEAVEIVSEVLKNA

SEQ ID NO: 201 - DNA, 1746 bp, Bacillus subtilis
atgacttggagaaagagctatgaacgctggaaacagacagaacatttagatctggaattaaaagagcgccttattgaattagagggagatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataagtctccggagttcgcgatggaagcggcaaaaacacttgcgacacaaggcatccaaacatacgtgtttgatgagcttcgcccgacgccagagctgtcattcgctgttagacagctgaacgcttatggtggaattgtggtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtccatttctgtacatcctgaattatcggaagaagtagatgtaaaggttgttttcacaccgctgcatggaactgcaaataaaccggtcagacgcggtcttgaagcactcggctacaaaaatgtaacggttgtcaaagaacaggaactgccggattcaaacttctccactgttacatcgccgaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgttgctgcttcattacctgctttctgaaaagaaaaaacaaggcatcctgcctgataacggtgttgttctcaaaacgatcgtcacaagcgaaatcggccgtgctgtagcttcttcattcggccttgatacgattgatacgctgacaggctttaagtttatcggtgaaaagattaaggaatacgaagcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgaatatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaagcaaagaagaagccatcgacttgccaaaatcaaatgtattgaaatacttcctggaagacgggtcttggttctgtctccgtccttctggaactgagccgaaggttaaattttatttcgccgtaaaagggtcatctttggaagacagtgaaaagcgacttgccgtcctttctgaagatgtaatgaagacggtggatgaaattgttgagtcaacagcaaaataa

SEQ ID NO: 202 - protein, 581 aa, Bacillus subtilis
MTWRKSYERWKQTEHLDLELKERLIELEGDEQALEDCFYKDLEFGTGGMRGEIGAGTNRMNIYTVRKASAGFAAYISKQGEEAKKRGVVIAYDSRHKSPEFAMEAAKTLATQGIQTYVFDELRPTPELSFAVRQLNAYGGIVVTASHNPPEYNGYKVYGDDGGQLPPKEADIVIEQVNAIENELTITVDEENKLKEKGLIKIIGEDIDKVYTEKLTSISVHPELSEEVDVKVVFTPLHGTANKPVRRGLEALGYKNVTVVKEQELPDSNFSTVTSPNPEEHAAFEYAIKLGEEQNADILIATDPDADRLGIAVKNDQGKYTVLTGNQTGALLLHYLLSEKKKQGILPDNGVVLKTIVTSEIGRAVASSFGLDTIDTLTGFKFIGEKIKEYEASGQYTFQFGYEESYGYLIGDFARDKDAIQAALLAVEVCAFYKKQGMSLYEALINLFNEYGFYREGLKSLTLKGKQGAEQIEAILASFRQNPPQKMAGKQVVTAEDYAVSKRTLLTESKEEAIDLPKSNVLKYFLEDGSWFCLRPSGTEPKVKFYFAVKGSSLEDSEKRLAVLSEDVMKTVDEIVESTAK

SEQ ID NO: 203 - DNA, 666 bp, Lactococcus lactis
atgtttaaagcagtattgtttgatttagatggtgtaattacagataccgcagagtatcattttagagcttggaaagctttggctgaagaaattggcattaatggtgttgaccgccaatttaatgagcaattaaaaggggtctcacgagaagactcgcttcagaaaattctagatttagctgataaaaaagtatcagctgaggaatttaaagaacttgctaagagaaaaaatgataactatgtgaaaatgattcaggatgtgtcgccagccgatgtctatcctggaattttacaattactcaaagatttacgttcaaataaaatcaaaattgctttagcatcggcttctaagaatggtccatttttattagagaaaatgaatttaactggatattttgatgcaattgctgatccggctgaagttgcagcatcaaaaccagcaccagatatttttattgcagcagcacatgcagtgggtgttgccccctctgaatcaattgggttagaggattctcaagctggaattcaagccatcaaagattcaggggctttaccaattggtgtagggcgcccagaagatttgggagatgatatcgtcattgtgcctgatacttcatactatacattagaatttttgaaagaagtttggcttcaaaagcaaaaatga

SEQ ID NO: 204 - protein, 221 aa, Lactococcus lactis
MFKAVLFDLDGVITDTAEYHFRAWKALAEEIGINGVDRQFNEQLKGVSREDSLQKILDLADKKVSAEEFKELAKRKNDNYVKMIQDVSPADVYPGILQLLKDLRSNKIKIALASASKNGPFLLEKMNLTGYFDAIADPAEVAASKPAPDIFIAAAHAVGVAPSESIGLEDSQAGIQAIKDSGALPIGVGRPEDLGDDIVIVPDTSYYTLEFLKEVWLQKQK

SEQ ID NO: 205 - DNA, 660 bp, Escherichia coli
atgaaactgcaaggggtaattttcgatctggatggtgtaatcaccgataccgcgcatctgcatttccaggcgtggcagcagattgccgctgaaattggcatcagcattgatgcgcagtttaacgaatccctaaaagggatcagccgcgatgagtctctgcggcgcattctgcaacacgggggcaaagagggcgactttaactcgcaggagagggcgcaactggcgtatcgcaaaaatctgctctatgtccactcactacgcgagttgacggtcaacgctgttctacccggcattcgctctttgctggcagatctccgtgcacagcagatctcggttgggctggcttctgtctccctgaatgcgccgacgattttagcggcgctggagctgcgcgagtttttcaccttctgcgcggatgcttcccaacttaaaaactcgaaaccggacccggaaatctttctcgccgcctgtgcagggctgggcgtgccgccgcaggcatgtatcggcattgaagatgcgcaggcgggcattgacgccattaacgccagcggtatgcgctcggtggggatcggcgcgggcttaaccggggcgcaattactgttgccttcaacggaatcactcacctggccgcggttatcggccttctggcaaaacgtatag

SEQ ID NO: 206 - protein, 219 aa, Escherichia coli [sequence omitted]

SEQ ID NO: 207 - DNA, 1392 bp, Pseudomonas aeruginosa
atgagcactgtaaaagcaccgacgctgcccgccagcatcttccgcgcctacgacatccgtcgcgtggtaggcgataccctcaccgccgagaccgcctactggatcggtcgcgccatcggctcggaaagcctcgcccgcggcgaaccgtgcgtcgctgtcggccgcgatggccgcctgtccggtcccgagctggtcaagcagctgatccagggcctggtggactgcggttgccaggtcagcgacgtgggcatggtgcctaccccggtgctgtactacgcggccaacgtgctcgagggcaagtccggggtgatgctgaccggcagccacaatccgccggactacaacggcttcaagatcgtggtcgccggcgagaccctggccaacgagcagatccaggccctgcgcgagcgcatcgagaaaaacgacctggcatccggcgtcggcagcgtagagcaggtcgacatcctgccgcgctacttcaagcagatccgcgacgacatcgccatggccaagccgatgaaggtggtggtcgactgcggcaacggcgtggccggggtgatcgccccgcagttgatcgaggccctgggctgcagcgtgatcccgctgtactgcgaggtcgacggcaacttcccgaaccaccatccggacccgggcaagccggagaacctgaaggacctgatcgccaaggtcaaggccgagaacgccgacctgggcctggccttcgacggcgacggcgatcgcgtcggcgtggtcaccaataccggtaccatcatctatccggaccgtctgctgatgctgttcgccaaggacgtggtctcgcgcaacccgggggccgacatcatcttcgacgtcaagtgcacccgccgtctgatcgccctgatcagcggctacggcggccgtccggtgatgtggaagaccggccactcgctgatcaagaagaagatgaaggaaaccggcgccctgctggctggcgagatgagcggccacgtgttcttcaaggagcgctggttcggcttcgacgatggcatctacagcgccgcccgcctgctggaaatcctcagccaggatcagcgtgacagcgagcacgtgttctcggccttcccgagcgacatttccaccccggaaatcaacatcaccgtcaccgaggacagcaagttcgccatcatcgaggcgctgcaacgcgacgcccaatggggcgaaggcaacatcaccaccctcgacggcgtgcgggtcgactaccccaaaggctggggcctggtacgcgcctccaacaccactcccgtgctggtcctgcgcttcgaagcggaccccgaggaagagctggagcgcatcaagaccgtcttccgtaaccaactgaaggcagtggattcctcgctgcccgtgcccttctga

SEQ ID NO: 208 - protein, 463 aa, Pseudomonas aeruginosa
MSTAKAPTLPASIFRAYDIRGVVGDTLTAETAYWIGRAIGSESLARGEPCVAVGRDGRLSGPELVKQLIQGLVDCGCQVSDVGMVPTPVLYYAANVLEGKSGVMLTGSHNPPDYNGFKIVVAGETLANEQIQALRERIEKNDLASGVGSVEQVDILPRYFKQIRDDIAMAKPMKVVVDCGNGVAGVIAPQLIEALGCSVIPLYCEVDGNFPNHHPDPGKPENLKDLIAKVKAENADLGLAFDGDGDRVGVVTNTGTIIYPDRLLMLFAKDVVSRNPGADIIFDVKCTRRLIALISGYGGRPVMWKTGHSLIKKKMKETGALLAGEMSGHVFFKERWFGFDDGIYSAARLLEILSQDQRDSEHVFSAFPSDISTPEINITVTEDSKFAIIEALQRDAQWGEGNITTLDGVRVDYPKGWGLVRASNTTPVLVLRFEADTEEELERIKTVFRNQLKAVDSSLPVPF

SEQ ID NO: 209 - DNA, 1371 bp, Escherichia coli
atgaaaaaattaacctgctttaaagcctatgatattcgcgggaaattaggcgaagaactgaatgaagatatcgcctggcgcattggtcgcgcctatggcgaatttctcaaaccgaaaaccattgtgttaggcggtgatgtccgcctcaccagcgaaaccttaaaactggcgctggcgaaaggtttacaggatgcgggcgttgacgtgctggatattggtatgtccggcaccgaagagatctatttcgccacgttccatctcggcgtggatggcggcattgaagttaccgccagccataatccgatggattataacggcatgaagctggttcgcgagggggctcgcccgatcagcggagataccggactgcgcgacgtccagcgtctggctgaagccaacgactttcctcccgtcgatgaaaccaaacgcggtcgctatcagcaaatcaacctgcgtgacgcttacgttgatcacctgttcggttatatcaatgtcaaaaacctcacgccgctcaagctggtgatcaactccgggaacggcgcagcgggtccggtggtggacgccattgaagcccgctttaaagccctcggcgcgcccgtggaattaatcaaagtgcacaacacgccggacggcaatttccccaacggtattcctaacccactactgccggaatgccgcgacgacacccgcaatgcggtcatcaaacacggcgcggatatgggcattgcttttgatggcgattttgaccgctgtttcctgtttgacgaaaaagggcagtttattgagggctactacattgtcggcctgttggcagaagcattcctcgaaaaaaatcccggcgcgaagatcatccacgatccacgtctctcctggaacaccgttgatgtggtgactgccgcaggtggcacgccggtaatgtcgaaaaccggacacgcctttattaaagaacgtatgcgcaaggaagacgccatctatggtggcgaaatgagcgcccaccattacttccgtgatttcgcttactgcgacagcggcatgatcccgtggctgctggtcgccgaactggtgtgcctgaaagataaaacgctgggcgaactggtacgcgaccggatggcggcgtttccggcaagcggtgagatcaacagcaaactggcgcaacccgttgaggcgattaaccgcgtggaacagcattttagccgtgaggcgctggcggtggatcgcaccgatggcatcagcatgacctttgccgactggcgctttaacctgcgcacctccaataccgaaccggtggtgcgcctgaatgtggaatcgcgcggtgatgtgccgctgatggaagcgcgaacgcgaactctgctgacgttgctgaacgagtaa

SEQ ID NO: 210 - protein, 456 aa, Escherichia coli
MKKLTCFKAYDIRGKLGEELNEDIAWRIGRAYGEFLKPKTIVLGGDVRLTSETLKLALAKGLQDAGVDVLDIGMSGTEEIYFATFHLGVDGGIEVTASHNPMDYNGMKLVREGARPISGDTGLRDVQRLAEANDFPPVDETKRGRYQQINLRDAYVDHLFGYINVKNLTPLKLVINSGNGAAGPVVDAIEARFKALGAPVELIKVHNTPDGNFPNGIPNPLLPECRDDTRNAVIKHGADMGIAFDGDFDRCFLFDEKGQFIEGYYIVGLLAEAFLEKNPGAKIIHDPRLSWNTVDVVTAAGGTPVMSKTGHAFIKERMRKEDAIYGGEMSAHHYFRDFAYCDSGMIPWLLVAELVCLKDKTLGELVRDRMAAFPASGEINSKLAQPVEAINRVEQHFSREALAVDRTDGISMTFADWRFNLRTSNTEPVVRLNVESRGDVPLMEARTRTLLTLLNE

SEQ ID NO: 211 - DNA, 2478 bp, Bifidobacterium dentium
atgacgagtcctgttattggcaccccttggaagaagctgaacgctccggtttccgaggaagctatcgaaggtgtggataagtactggcgtgcagccaactacctctccatcggccagatctatctgcgtagcaacccgctgatgaaggagcccttcacccgcgaagacgtcaagcaccgtctggtcggccactggggcaccaccccgggcctgaacttcctcatcggccacatcaaccgtctcatcgctgatcaccagcagaacaccgtgatcatcatgggcccgggccacggcggcccggctggtaccgctcagtcctacctggacggcacctacaccgagtacttcccgaacatcaccaaggatgaagctggcctgcagaagttcttccgccagttctcctacccgggcggcatcccgtcccactacgctccggagaccccgggctccatccacgaaggtggcgagctgggttacgccctgtcccacgcctatggcgctgtgatgaacaacccgagcctgttcgttccggccatcgtcggcgacggcgaagccgagaccggcccgctggccaccggctggcagtccaacaagctcgtcaacccgcgcaccgacggtatcgtgctgccgatcctgcacctcaatggctacaagatcgccaacccgaccatcctgtcccgcatctccgacgaagagctgcacgagttcttccacggcatgggctatgagccgtatgagttcgtcgccggcttcgacaacgaggatcacctgtcgatccaccgtcgtttcgccgagttgttcgagaccgtcttcgacgagatctgcgacatcaaggccgccgctcagactgacgacatgactcgtccgttctacccgatgatcatcttccgcaccccgaagggctggacctgcccgaagttcatcgacggcaagaagaccgaaggttcctggcgctcccaccaggttccgctggcttccgcccgcgataccgaggctcacttcgaggtcctcaagaactggctcgagtcctacaagccggaagagctgttcgacgccaacggcgccgtgaagccggaagtcaccgccttcatgccgaccggcgaactgcgcatcggtgagaacccgaacgccaacggtggccgcatccgcgaagagctgaacctgccggccctcgaggactacgaggtcaaggaagtcgccgagtacggccacggctggggccagctcgaggccacccgtcgtctgggcgtctacacccgcgacatcatcaagaacaacccggactccttccgtatcttcggaccggacgagaccgcttccaaccgtctgcaggccgcatacgacgtcaccaacaagcagtgggacgccggctacctgtccgctcaggttgatgagcacatggccgtcaccggtcaggtcaccgagcagctctccgagcaccagatggaaggcttcctcgaggcctacctgctcaccggccgtcacggcatctggagctcctacgagtccttcgtgcacgtgatcgactccatgctgaaccagcacgccaagtggctcgaggctaccgtccgcgagatcccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgccgtggctgagaagtgctacaagtccaccgacatgatcaacgccatcatcgccggcaagcagccggccgccacctggctgaccctggacgaagctcgcgccgagctcgagaagggtgccgccgagtgggagtgggcctccaccgccaagtccaacgacgaagcacagatcgtgctcgcctccgctggcgatgtcccggctcaggagatcatggccgctgccgacaagctcgatgccatgggcatcaagttcaaggtcgtcaacgttgtggatctggtcaagctgcagtccaccaaggagaatgacgaagccatctccgacgccgacttcgctgacctgttcaccgaggacaagccggtcctgttcgcctaccactcctatgcccgcgacgtgcgtggtctgatctacgatcgcccgaaccacgacaacttcaacgtccacggctacgaggagcagggctccaccaccaccccgtacgacatggtgcgcgtgaacaacatcgatcgctacgagctcgttgccgaagctctgcgcatgatcgacgctgacaagtacgccgacaagatcgacgagctcgaggccttccgcaaggaagccttccagttcgcagtcgacaacggctacgatcacccggattacaccgactgggtgtactccggcgtcaacaccaacaagcagggtgctgtctccgctaccgccgcaaccgccggcgataacgagtga

SEQ ID NO: 212 - protein, 825 aa, Bifidobacterium dentium
MTSPVIGTPWKKLNAPVSEEAIEGVDKYWRAANYLSIGQIYLRSNPLMKEPFTREDVKHRLVGHWGTTPGLNFLIGHINRLIADHQQNTVIIMGPGHGGPAGTAQSYLDGTYTEYFPNITKDEAGLQKFFRQFSYPGGIPSHYAPETPGSIHEGGELGYALSHAYGAVMNNPSLFVPAIVGDGEAETGPLATGWQSNKLVNPRTDGIVLPILHLNGYKIANPTILSRISDEELHEFFHGMGYEPYEFVAGFDNEDHLSIHRRFAELFETVFDEICDIKAAAQTDDMTRPFYPMIIFRTPKGWTCPKFIDGKKTEGSWRSHQVPLASARDTEAHFEVLKNWLESYKPEELFDANGAVKPEVTAFMPTGELRIGENPNANGGRIREELNLPALEDYEVKEVAEYGHGWGQLEATRRLGVYTRDIIKNNPDSFRIFGPDETASNRLQAAYDVTNKQWDAGYLSAQVDEHMAVTGQVTEQLSEHQMEGFLEAYLLTGRHGIWSSYESFVHVIDSMLNQHAKWLEATVREIPWRKPISSMNLLVSSHVWRQDHNGFSHQDPGVTSVLLNKCFNNDHVIGIYFPVDSNMLLAVAEKCYKSTDMINAIIAGKQPAATWLTLDEARAELEKGAAEWEWASTAKSNDEAQIVLASAGDVPAQEIMAAADKLDAMGIKFKVVNVVDLVKLQSTKENDEAISDADFADLFTEDKPVLFAYHSYARDVRGLIYDRPNHDNFNVHGYEEQGSTTTPYDMVRVNNIDRYELVAEALRMIDADKYADKIDELEAFRKEAFQFAVDNGYDHPDYTDWVYSGVNTNKQGAVSATAATAGDNE

SEQ ID NO: 213 - DNA, 2478 bp, Bifidobacterium lactis
atgactaatcctgttattggtaccccatggcagaagctggatcgtccggtttccgaagaggccatcgaaggcatggacaagtactggcgcgtcgccaactacatgtctatcggccagatctacctgcgtagcaacccgctgatgaaggagcccttcacccgcgatgacgtgaagcaccgtctggtcggccactggggcaccaccccgggcctgaacttccttctcgcccacatcaaccgcctgatcgccgatcaccagcagaacaccgtgttcatcatgggtcctggccacggcggccctgcaggtaccgctcagtcctacatcgacggcacctacaccgagtactacccgaacatcaccaaggacgaagctggcctgcagaagttcttccgccagttctcctacccgggtggcattccttcccacttcgctccggagacgccgggctccatccacgaaggcggcgagctgggctacgccctgtcgcacgcctacggcgcgatcatggacaacccgagcctcttcgtcccgtgcatcatcggtgacggcgaagccgagaccggccctctggccaccggctggcagtccaacaagctcgtcaacccgcgcaccgacggcatcgtcctgccgatcctgcacctcaacggctacaagatcgccaacccgacgatcctcgcccgcatctccgacgaggagctgcacgacttcttccgcggcatgggttaccacccgtacgagttcgtcgccggcttcgacaacgaggatcacctgtcgatccaccgtcgcttcgccgagctcttcgagaccatcttcgacgagatctgcgatatcaaggctgcggctcagaccgacgacatgacccgtccgttctacccgatgctcatcttccgcaccccgaagggctggacctgcccgaagttcatcgacggcaagaagaccgaaggctcctggcgtgcacaccaggtcccgctggcttccgcccgcgacaccgaggcccacttcgaagtcctcaagggctggatggaatcctacaagccggaggagctcttcaacgccgacggctccatcaaggaggacgtcaccgcattcatgcctaagggcgaactgcgcatcggcgccaacccgaatgccaacggcggccgcatccgcgaggatctgaagctccctgagctcgatcagtacgagatcaccggcgtcaaggaatacggccacggttggggccaggtcgaggctccgcgttccctcggcgcgtactgccgcgacatcatcaagaacaacccggattcgttccgcgtcttcggacctgacgagaccgcgtccaaccgtctgaacgcgacctacgaggtcaccaagaagcagtgggacaacggatacctctcggctctcgtcgacgagaacatggccgtcaccggccaggttgtcgagcagctctccgagcatcagtgcgaaggcttcctcgaggcctacctgctcaccggccgtcacggcatctggagctcctacgagtccttcgtgcacgtgatcgactccatgctgaaccagcatgcgaagtggctcgaggccaccgtccgcgagatcccgtggcgtaagccgatctcctcggtgaacctcctggtctcctcgcacgtgtggcgtcaggatcacaacggcttctcgcaccaggatccgggtgtgacctccgtcctgctgaacaagacgttcaacaacgaccacgtgacgaacatctacttcgcgaccgatgccaacatgctgctggccatcgccgagaagtgcttcaagtccaccaacaagatcaacgcaatcttcgccggcaagcagccggccgcgacgtggatcaccctcgacgaggtacgcgccgagctcgaggctggtgccgccgagtggaagtgggcttccaacgccaagagcaacgacgaggtccaggttgtcctcgccgccgccggcgacgtcccgacccaggagatcatggccgcttccgatgccctcaacaagatgggcatcaagttcaaggtcgtcaacgtcgtggacctcatcaagctgcagtcctcgaaggagaacgacgaggccatgtctgacgaggacttcgccgacctgttcaccgcggacaagccggtcctcttcgcctaccactcctatgcccaggacgttcgtggcctcatctacgaccgcccgaaccacgacaacttcaccgttgtcggatacaaggagcagggctccacgacgacgccgttcgacatggtgcgtgtcaacgacatggatcgctacgcccttcaggccaaggccctcgagctcatcgacgccgacaagtatgccgacaagatcaacgagctcaacgagttccgcaagaccgcgttccagttcgccgtcgacaatggctatgacattcctgagttcaccgattgggtgtacccggatgtcaaggtcgacgagacctccatgctctccgccaccgccgcgaccgccggcgacaacgagtga

SEQ ID NO: 214 - protein, 825 aa, Bifidobacterium lactis
MTNPVIGTPWQKLDRPVSEEAIEGMDKYWRVANYMSIGQIYLRSNPLMKEPFTRDDVKHRLVGHWGTTPGLNFLLAHINRLIADHQQNTVFIMGPGHGGPAGTAQSYIDGTYTEYYPNITKDEAGLQKFFRQFSYPGGIPSHFAPETPGSIHEGGELGYALSHAYGAIMDNPSLFVPCIIGDGEAETGPLATGWQSNKLVNPRTDGIVLPILHLNGYKIANPTILARISDEELHDFFRGMGYHPYEFVAGFDNEDHLSIHRRFAELFETIFDEICDIKAAAQTDDMTRPFYPMLIFRTPKGWTCPKFIDGKKTEGSWRAHQVPLASARDTEAHFEVLKGWMESYKPEELFNADGSIKEDVTAFMPKGELRIGANPNANGGRIREDLKLPELDQYEITGVKEYGHGWGQVEAPRSLGAYCRDIIKNNPDSFRVFGPDETASNRLNATYEVTKKQWDNGYLSALVDENMAVTGQVVEQLSEHQCEGFLEAYLLTGRHGIWSSYESFVHVIDSMLNQHAKWLEATVREIPWRKPISSVNLLVSSHVWRQDHNGFSHQDPGVTSVLLNKTFNNDHVTNIYFATDANMLLAIAEKCFKSTNKINAIFAGKQPAATWITLDEVRAELEAGAAEWKWASNAKSNDEVQVVLAAAGDVPTQEIMAASDALNKMGIKFKVVNVVDLIKLQSSKENDEAMSDEDFADLFTADKPVLFAYHSYAQDVRGLIYDRPNHDNFTVVGYKEQGSTTTPFDMVRVNDMDRYALQAKALELIDADKYADKINELNEFRKTAFQFAVDNGYDIPEFTDWVYPDVKVDETSMLSATAATAGDNE

SEQ ID NO: 215 - DNA, 2367 bp, Unknown
  Lactobacillus paraplantarum Sequence
  misc_feature (75)..(75): n is a, c, g, or t
atgacaacagattactcatcaccagcatatttgcaaaaagttgataagtactggcgggcagccaactacttatcngttgggcaactttatttaaaagattatccattattacaacagccattgaaggccagtgacgttaaggttcatccaatttgtcactgggggacgattgccggtcaaaactctatctacgcgcaccttaaccgggttattaacaagtacggtttgaagatgttctacgttgaaggtccaggtcatggtggtcaagtgatggtttcaaactcttatcttgacggtacttacaccgatatttatccagaaattacgcaggatgttgaaggaatgcagaaactcttcaagcaattctcattcccaggtggggttgcttcccatgcggcacctgaaacacctggttcaatccacgaaggtggcgaactaggttactcaatttcacacggggttggggcaattcttgacaatcctgacgaaattgcagcggtcgttgttggtgatggggaatccgaaacgggtccattagcaacttcatggcaatcaacgaagttcattaacccaatcaatgacggggcagtgttaccaatcttgaacttaaatggttttaagatttctaacccaacgatttttggtcggacttctgatgctaagattaaggaatacttcgaaagcatgagctgggaaccaatcttcgttgaaggtgacgatcctgaaaaggttcacccagtcttagctaaagccatggatgaagccgttgaaaagatcaaggcaatccagaagcatgctcgtgaaaatgacgatgcgacgttgccagtatggccaatgatcgttttccgtgcacctaagggctggactggtcctaagtcatgggacggcgataagattgaaggttcattccgggcccatcaaattccgattcctgttgatcaaaatgacatggaacatgcggacgctttagttgattggcttgaatcatatcaaccaaaggaactcttcaatgaagatggttctttgaaggatgatattaaagaaattattcctactggggacagtcggatggcagctaacccaatcaccaatggtggggttgatccgaaagccttgaacttaccaaacttccgggattatgcggtcgatacgtccaaggaaggcgcgaatgttaagcaagatatgcttgtttggtcagactatttgcgggatgtcatcaagaagaatcctgataacttccggttgttcggacctgatgaaaccatgtctaaccgcttatatggtgtcttcgaaaccactaatcgtcaatggatggaagacattcatcccgatagtgaccaatatgaagctgcagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaggccaatgaacttgattggcgtaaaaagtacccatcacttaacattatcgcggcttcaactgtattccaacaagaccataatggttacacccaccaagatccaggtgcgttgactcatttggccgaaaagaaaccagaatacattcgcgaatatttaccagccgatgccaacacgttattagctgtcggtgacgtcattttccggagccaagaaaagatcaactacgtggttacgtcaaaacacccacgtcaacaatggttcagcattgaagaagctaaacaattagttgacaatggtcttggtatcattgactgggcaagcacggatcaaggtagcgaaccagacatcgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccacggggcttgtcagatgctgaatttgaccattactttactaaggacaaaccagtggtctttgctttccacggttacgaagatttagttcgtgacatcttcttcgatcgtcacaaccataacttatacgtccacggttaccgtgaaaatggtgatattaccacaccattcgacgtacgggtcatgaaccaaatggatcgtttcgacttagctaagacggcgattgcggcgcaaccagcaatggaaaacaccggtgcggcctttgttcaatccatggataacatgcttgctaaacacaatgcatacattcgggatgccggaaccgacttgccagaagttaacgactggcaatggaaaggtttgaaataa

SEQ ID NO: 216 - protein, 788 aa, Unknown
  Lactobacillus paraplantarum Sequence
MTTDYSSPAYLQKVDKYWRAANYLSVGQLYLKDYPLLQQPLKASDVKVHPICHWGTIAGQNSIYAHLNRVINKYGLKMFYVEGPGHGGQVMVSNSYLDGTYTDIYPEITQDVEGMQKLFKQFSFPGGVASHAAPETPGSIHEGGELGYSISHGVGAILDNPDEIAAVVVGDGESETGPLATSWQSTKFINPINDGAVLPILNLNGFKISNPTIFGRTSDAKIKEYFESMSWEPIFVEGDDPEKVHPVLAKAMDEAVEKIKAIQKHARENDDATLPVWPMIVFRAPKGWTGPKSWDGDKIEGSFRAHQIPIPVDQNDMEHADALVDWLESYQPKELFNEDGSLKDDIKEIIPTGDSRMAANPITNGGVDPKALNLPNFRDYAVDTSKEGANVKQDMLVWSDYLRDVIKKNPDNFRLFGPDETMSNRLYGVFETTNRQWMEDIHPDSDQYEAAAGRVLDAQLSEHQAEGWLEGYVLTGRHGLFASYEAFLRVVDSMLTQHFKWLRKANELDWRKKYPSLNIIAASTVFQQDHNGYTHQDPGALTHLAEKKPEYIREYLPADANTLLAVGDVIFRSQEKINYVVTSKHPRQQWFSIEEAKQLVDNGLGIIDWASTDQGSEPDIVFAAAGTEPTLETLAAIQLLHDSFPEMKIRFVNVVDILKLRSPEKDPRGLSDAEFDHYFTKDKPVVFAFHGYEDLVRDIFFDRHNHNLYVHGYRENGDITTPFDVRVMNQMDRFDLAKTAIAAQPAMENTGAAFVQSMDNMLAKHNAYIRDAGTDLPEVNDWQWKGLK

SEQ ID NO: 217 - DNA, 2478 bp, Bifidobacterium breve
atgacaaatcctgttattggcaccccgtggcagaagctggatcgcccggtttccgaagaagccatcgaaggcatggacaagtattggcgcgtcaccaactacatgtccatcggccagatctatctgcgtagcaacccgctgatgaaggaacccttcacccgcgatgacgtgaagcaccgtctggtcggccactggggcaccaccccgggcctgaacttccttctcgcccacatcaaccgcctcatcgctgaccaccagcagaacaccgtgttcatcatgggcccgggccacggcggcccggctggcacctcccagtcttacgttgacggcacgtacaccgagtactacccgaacatcaccaaggacgaagctggcctgcagaagttcttccgccagttctcctacccgggcggcatcccgtcgcacttcgccccggagaccccgggatcgatccacgaaggtggcgagcttggctacgcgctctcccacgcatacggcgccgtgatgaacaacccgagcctgttcgtgccgtgcatcatcggcgacggcgaggccgagaccggcccgctcgccaccggctggcagtccaacaagctcgtcaacccgcgcaccgacggcatcgtgctgccgatcctgcacctcaacggctacaagatcgccaacccgaccatcctcgctcgtatctccgacgaagagctgcatgacttcttccgcggcatgggctaccacccgtacgagttcgttgccggcttcgacaacgaggaccacatgtcgatccaccgtcgtttcgccgagctgttcgagacgatcttcgacgagatctgcgacatcaaggctgcggcccagaccgacgacatgacccgtccgttctacccgatgctcatcttccgcaccccgaagggctggacctgcccgaagttcatcgacggcaagaagaccgaaggctcctggcgtgcgcaccaggtcccgctggcttccgcccgcgacaccgaagagcacttcgaagtcctcaagggctggatggaatcctacaagccggaagagctcttcaacgccgacggctccatcaaggatgacgtcaccgcgttcatgccgaagggcgagctccgcatcggcgccaacccgaacgccaacggtggtgtgatccgcgaggacctgaagctccccgagctcgaccagtacgaggtcaccggcgtcaaggagtacggccatggctggggccaggtcgaggctccgcgtgccctcggtgcatactgccgcgacatcatcaagaacaacccggattcgttccgcatcttcggaccggacgagaccgcttccaaccgcctgaacgcgacctacgaggtcaccgacaagcagtgggacaacggctacctttcgggtctcgtcgacgagcacatggcggtcaccggtcaggtcaccgagcagctctccgagcaccagtgcgagggcttcctcgaggcgtacctcctcaccggccgccacggcatctggagctcctacgagtccttcgtccacgtcatcgactcgatgctcaaccagcatgcgaagtggctcgaggccaccgtccgcgagatcccgtggcgcaagccgatctcctcggtgaacctcctcgtctcctcgcacgtgtggcgtcaggatcacaacggcttctcgcaccaggatccgggtgtcacctcgctcctgatcaacaagacgttcaacaacgatcacgtgacgaacatctacttcgcgaccgacgcgaacatgctgctcgcgatctccgagaagtgcttcaagtccaccaacaagatcaatgcgatcttcgccggcaagcagcctgctccgacgtgggtcacgctcgatgaggcccgcgccgagctcgaagccggcgccgctgagtggaagtgggcttccaacgccgagaacaacgatgaggtccaggtcgtcctcgcttccgctggcgatgtgccgacccaggagctcatggccgcctccgatgccctcaacaagatgggcatcaagttcaaggtcgtcaacgttgttgacctcctgaagctgcagtcccgcgagaacaacgacgaggccctcacggacgaggagttcaccgaactcttcaccgccgacaagccggttctgttcgcataccactcctacgctcaggatgttcgcggcctcatctacgaccgcccgaaccacgacaacttccacgtcgtcggctacaaggagcagggctccacgaccacgccgttcgacatggtccgcgtcaacgacatggatcgctatgcgctccaggccgctgccctcaagctgatcgatgccgacaagtacgccgacaagatcgacgagctcaacgcgttccgcaagaaggcgttccagttcgctgtcgacaacggctacgacatcccggagttcaccgactgggtgtacccggatgtcaaggtcgacgagacgcagatgctttccgcgaccgcggcgaccgcaggcgacaacgagtga

SEQ ID NO: 218 - protein, 825 aa, Bifidobacterium breve
MTNPVIGTPWQKLDRPVSEEAIEGMDKYWRVTNYMSIGQIYLRSNPLMKEPFTRDDVKHRLVGHWGTTPGLNFLLAHINRLIADHQQNTVFIMGPGHGGPAGTSQSYVDGTYTEYYPNITKDEAGLQKFFRQFSYPGGIPSHFAPETPGSIHEGGELGYALSHAYGAVMNNPSLFVPCIIGDGEAETGPLATGWQSNKLVNPRTDGIVLPILHLNGYKIANPTILARISDEELHDFFRGMGYHPYEFVAGFDNEDHMSIHRRFAELFETIFDEICDIKAAAQTDDMTRPFYPMLIFRTPKGWTCPKFIDGKKTEGSWRAHQVPLASARDTEEHFEVLKGWMESYKPEELFNADGSIKDDVTAFMPKGELRIGANPNANGGVIREDLKLPELDQYEVTGVKEYGHGWGQVEAPRALGAYCRDIIKNNPDSFRIFGPDETASNRLNATYEVTDKQWDNGYLSGLVDEHMAVTGQVTEQLSEHQCEGFLEAYLLTGRHGIWSSYESFVHVIDSMLNQHAKWLEATVREIPWRKPISSVNLLVSSHVWRQDHNGFSHQDPGVTSLLINKTFNNDHVTNIYFATDANMLLAISEKCFKSTNKINAIFAGKQPAPTWVTLDEARAELEAGAAEWKWASNAENNDEVQVVLASAGDVPTQELMAASDALNKMGIKFKVVNVVDLLKLQSRENNDEALTDEEFTELFTADKPVLFAYHSYAQDVRGLIYDRPNHDNFHVVGYKEQGSTTTPFDMVRVNDMDRYALQAAALKLIDADKYADKIDELNAFRKKAFQFAVDNGYDIPEFTDWVYPDVKVDETQMLSATAATAGDNE

SEQ ID NO: 219 - DNA, 2145 bp, Escherichia coli
gtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcgtcgcaaactaccacgctaacaccaaagacgctgaagtcgttctggttgaaggtctggtcccgacacgtaagcaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgccaaaaacaccaacatcaccggcgttatcgttaacaaactgaacgcaccggttgatgaacagggtcgtactcgcccggatctgtccgagattttcgacgactcttccaaagctaaagtaaacaatgttgatccggcgaagctgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgtcctgacgtgctggtggccgcttgcctggcagccatgaacggcgtagaaatcggtgccctgctgctgactggcggttacgaaatggacgcgcgcatttctaaactgtgcgaacgtgctttcgctaccggcctgccggtatttatggtgaacaccaacacctggcagacctctctgagcctgcagagcttcaacctggaagttccggttgacgatcacgaacgtatcgagaaagttcaggaatacgttgctaactacatcaacgctgactggatcgaatctctgactgccacttctgagcgcagccgtcgtctgtctccgcctgcgttccgttatcagctgactgaacttgcgcgcaaagcgggcaaacgtatcgtactgccggaaggtgacgaaccgcgtaccgttaaagcagccgctatctgtgctgaacgtggtatcgcaacttgcgtactgctgggtaatccggcagagatcaaccgtgttgcagcgtctcagggtgtagaactgggtgcagggattgaaatcgttgatccagaagtggttcgcgaaagctatgttggtcgtctggtcgaactgcgtaagaacaaaggcatgaccgaaaccgttgcccgcgaacagctggaagacaacgtggtgctcggtacgctgatgctggaacaggatgaagttgatggtctggtttccggtgctgttcacactaccgcaaacaccatccgtccgccgctgcagctgatcaaaactgcaccgggcagctccctggtatcttccgtgttcttcatgctgctgccggaacaggtttacgtttacggtgactgtgcgatcaacccggatccgaccgctgaacagctggcagaaatcgcgattcagtccgctgattccgctgcggccttcggtatcgaaccgcgcgttgctatgctctcctactccaccggtacttctggtgcaggtagcgacgtagaaaaagttcgcgaagcaactcgtctggcgcaggaaaaacgtcctgacctgatgatcgacggtccgctgcagtacgacgctgcggtaatggctgacgttgcgaaatccaaagcgccgaactctccggttgcaggtcgcgctaccgtgttcatcttcccggatctgaacaccggtaacaccacctacaaagcggtacagcgttctgccgacctgatctccatcgggccgatgctgcagggtatgcgcaagccggttaacgacctgtcccgtggcgcactggttgacgatatcgtctacaccatcgcgctgactgcgattcagtctgcacagcagcagtaa

SEQ ID NO: 220 - protein, 714 aa, Escherichia coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 221 - DNA, 1002 bp, Clostridium acetobutylicum
atggatttaatagaaagcatatgggagtgtgctaagcaagacaaaaaaaggataatattagctgaaggtgaagaaaaaagaaatctaattgccgcagataaaattatcaaagagggattagcagagcttgttcttgtaggtgatgaaaataaaattaaagaaaaagcaagtgagttgaatcttgacatttcgaaggctgaaataatggatccagagacatcactaaaaacagaaacatatgctagagatttttatgaacttagaaaacacaaaggaatgactattgaaaaatctgaaaaaatggtaagagatcctctttattttgcaacaatggctttaaaagatggctatgttgatggaatggtttcaggagctgttcacacaactggagatttattaagaccaggacttcaaattataaaaactgcaccaggagttaaaatagtatcaggattctttgttatgataatacctgactgcgattatggtgaagagggtcttttattatttgcagattgtgctgtaaatcctaacccaacatcagatgaactagctgatattgctataactacagctgaaacagctagaaaattatgtaacgtagagcctaaagttgcgatgctttcattctcaactatgggaagtgcaaaaggcgaaatggtagataaggttaaaaatgctgttgaaatcacaaagaaattcagaccggatcttgctattgatggtgagcttcagcttgatgctgcaatagatagtgaagtagcggctttaaaagcaccttctagtaatgttgcaggaaatgcaaatgttcttgtattcccagatcttcaaacaggaaacattgggtacaagcttgttcaaagatttgcaaaagcaaaagcaataggacctatatgtcaaggatttgcaaaacctattaatgatttatcaagaggctgtagctcagaggatatagtaaatgttgttgctataactgttgttcaggctcaaagaggtatataa

SEQ ID NO: 222 - protein, 333 aa, Clostridium acetobutylicum
MDLIESIWECAKQDKKRIILAEGEEKRNLIAADKIIKEGLAELVLVGDENKIKEKASELNLDISKAEIMDPETSLKTETYARDFYELRKHKGMTIEKSEKMVRDPLYFATMALKDGYVDGMVSGAVHTTGDLLRPGLQIIKTAPGVKIVSGFFVMIIPDCDYGEEGLLLFADCAVNPNPTSDELADIAITTAETARKLCNVEPKVAMLSFSTMGSAKGEMVDKVKNAVEITKKFRPDLAIDGELQLDAAIDSEVAALKAPSSNVAGNANVLVFPDLQTGNIGYKLVQRFAKAKAIGPICQGFAKPINDLSRGCSSEDIVNVVAITVVQAQRGI

SEQ ID NO: 223 - DNA, 1647 bp, Lactococcus lactis
atgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataa

SEQ ID NO: 224 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 225 - DNA, 2802 bp, Escherichia coli
atgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatctgaccgaagcagacttccaggagaccttcaacgtcggttcatttgccagcggcaaagaaaccatgaaactcggcgagctgctggaagccctcaagcaaacctactgcggcccgattggtgccgagtatatgcacattaccagcaccgaagaaaaacgctggatccaacagcgtatcgagtctggtcgcgcgactttcaatagcgaagagaaaaaacgcttcttaagcgaactgaccgccgctgaaggtcttgaacgttacctcggcgcaaaattccctggcgcaaaacgcttctcgctggaaggcggtgacgcgttaatcccgatgcttaaagagatgatccgccacgctggcaacagcggcacccgcgaagtggttctcgggatggcgcaccgtggtcgtctgaacgtgctggtgaacgtgctgggtaaaaaaccgcaagacttgttcgacgagttcgccggtaaacataaagaacacctcggcacgggtgacgtgaaataccacatgggcttctcgtctgacttccagaccgatggcggcctggtgcacctggcgctggcgtttaacccgtctcaccttgagattgtaagcccggtagttatcggttctgttcgtgcccgtctggacagacttgatgagccgagcagcaacaaagtgctgccaatcaccatccacggtgacgccgcagtgaccgggcagggcgtggttcaggaaaccctgaacatgtcgaaagcgcgtggttatgaagttggcggtacggtacgtatcgttatcaacaaccaggttggtttcaccacctctaatccgctggatgcccgttctacgccgtactgtactgatatcggtaagatggttcaggccccgattttccacgttaacgcggacgatccggaagccgttgcctttgtgacccgtctggcgctcgatttccgtaacacctttaaacgtgatgtcttcatcgacctggtgtgctaccgccgtcacggccacaacgaagccgacgagccgagcgcaacccagccgctgatgtatcagaaaatcaaaaaacatccgacaccgcgcaaaatctacgctgacaagctggagcaggaaaaagtggcgacgctggaagatgccaccgagatggttaacctgtaccgcgatgcgctggatgctggcgattgcgtagtggcagagtggcgtccgatgaacatgcactctttcacctggtcgccgtacctcaaccacgaatgggacgaagagtacccgaacaaagttgagatgaagcgcctgcaggagctggcgaaacgcatcagcacggtgccggaagcagttgaaatgcagtctcgcgttgccaagatttatggcgatcgccaggcgatggctgccggtgagaaactgttcgactggggcggtgcggaaaacctcgcttacgccacgctggttgatgaaggcattccggttcgcctgtcgggtgaagactccggtcgcggtaccttcttccaccgccacgcggtgatccacaaccagtctaacggttccacttacacgccgctgcaacatatccataacgggcagggcgcgttccgtgtctgggactccgtactgtctgaagaagcagtgctggcgtttgaatatggttatgccaccgcagaaccacgcactctgaccatctgggaagcgcagttcggtgacttcgccaacggtgcgcaggtggttatcgaccagttcatctcctctggcgaacagaaatggggccggatgtgtggtctggtgatgttgctgccgcacggttacgaagggcaggggccggagcactcctccgcgcgtctggaacgttatctgcaactttgtgctgagcaaaacatgcaggtttgcgtaccgtctaccccggcacaggtttaccacatgctgcgtcgtcaggcgctgcgcgggatgcgtcgtccgctggtcgtgatgtcgccgaaatccctgctgcgtcatccgctggcggtttccagcctcgaagaactggcgaacggcaccttcctgccagccatcggtgaaatcgacgagcttgatccgaagggcgtgaagcgcgtagtgatgtgttctggtaaggtttattacgacctgctggaacagcgtcgtaagaacaatcaacacgatgtcgccattgtgcgtatcgagcaactctacccgttcccgcataaagcgatgcaggaagtgttgcagcagtttgctcacgtcaaggattttgtctggtgccaggaagagccgctcaaccagggcgcatggtactgcagccagcatcatttccgtgaagtgattccgtttggggcttctctgcgttatgcaggccgcccggcctccgcctctccggcggtagggtatatgtccgttcaccagaaacagcaacaagatctggttaatgacgcgctgaacgtcgaataa

SEQ ID NO: 226 - protein, 933 aa, Escherichia coli
MQNSALKAWLDSSYLSGANQSWIEQLYEDFLTDPDSVDANWRSTFQQLPGTGVKPDQFHSQTREYFRRLAKDASRYSSTISDPDTNVKQVKVLQLINAYRFRGHQHANLDPLGLWQQDKVADLDPSFHDLTEADFQETFNVGSFASGKETMKLGELLEALKQTYCGPIGAEYMHITSTEEKRWIQQRIESGRATFNSEEKKRFLSELTAAEGLERYLGAKFPGAKRFSLEGGDALIPMLKEMIRHAGNSGTREVVLGMAHRGRLNVLVNVLGKKPQDLFDEFAGKHKEHLGTGDVKYHMGFSSDFQTDGGLVHLALAFNPSHLEIVSPVVIGSVRARLDRLDEPSSNKVLPITIHGDAAVTGQGVVQETLNMSKARGYEVGGTVRIVINNQVGFTTSNPLDARSTPYCTDIGKMVQAPIFHVNADDPEAVAFVTRLALDFRNTFKRDVFIDLVCYRRHGHNEADEPSATQPLMYQKIKKHPTPRKIYADKLEQEKVATLEDATEMVNLYRDALDAGDCVVAEWRPMNMHSFTWSPYLNHEWDEEYPNKVEMKRLQELAKRISTVPEAVEMQSRVAKIYGDRQAMAAGEKLFDWGGAENLAYATLVDEGIPVRLSGEDSGRGTFFHRHAVIHNQSNGSTYTPLQHIHNGQGAFRVWDSVLSEEAVLAFEYGYATAEPRTLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAVSSLEELANGTFLPAIGEIDELDPKGVKRVVMCSGKVYYDLLEQRRKNNQHDVAIVRIEQLYPFPHKAMQEVLQQFAHVKDFVWCQEEPLNQGAWYCSQHHFREVIPFGASLRYAGRPASASPAVGYMSVHQKQQQDLVNDALNVE

SEQ ID NO: 227 - DNA, 1233 bp, Escherichia coli
atggcaaaggtatcgctggagaaagacaagattaagtttctgctggtagaaggcgtgcaccaaaaggcgctggaaagccttcgtgcagctggttacaccaacatcgaatttcacaaaggcgcgctggatgatgaacaattaaaagaatccatccgcgatgcccacttcatcggcctgcgatcccgtacccatctgactgaagacgtgatcaacgccgcagaaaaactggtcgctattggctgtttctgtatcggaacaaaccaggttgatctggatgcggcggcaaagcgcgggatcccggtatttaacgcaccgttctcaaatacgcgctctgttgcggagctggtgattggcgaactgctgctgctattgcgcggcgtgccggaagccaatgctaaagcgcaccgtggcgtgtggaacaaactggcggcgggttcttttgaagcgcgcggcaaaaagctgggtatcatcggctacggtcatattggtacgcaattgggcattctggctgaatcgctgggaatgtatgtttacttttatgatattgaaaataaactgccgctgggcaacgccactcaggtacagcatctttctgacctgctgaatatgagcgatgtggtgagtctgcatgtaccagagaatccgtccaccaaaaatatgatgggcgcgaaagaaatttcactaatgaagcccggctcgctgctgattaatgcttcgcgcggtactgtggtggatattccggcgctgtgtgatgcgctggcgagcaaacatctggcgggggcggcaatcgacgtattcccgacggaaccggcgaccaatagcgatccatttacctctccgctgtgtgaattcgacaacgtccttctgacgccacacattggcggttcgactcaggaagcgcaggagaatatcggcctggaagttgcgggtaaattgatcaagtattctgacaatggctcaacgctctctgcggtgaacttcccggaagtctcgctgccactgcacggtgggcgtcgtctgatgcacatccacgaaaaccgtccgggcgtgctaactgcgctgaacaaaatcttcgccgagcagggcgtcaacatcgccgcgcaatatctgcaaacttccgcccagatgggttatgtggttattgatattgaagccgacgaagacgttgccgaaaaagcgctgcaggcaatgaaagctattccgggtaccattcgcgcccgtctgctgtactaa

SEQ ID NO: 228 - protein, 410 aa, Escherichia coli
MAKVSLEKDKIKFLLVEGVHQKALESLRAAGYTNIEFHKGALDDEQLKESIRDAHFIGLRSRTHLTEDVINAAEKLVAIGCFCIGTNQVDLDAAAKRGIPVFNAPFSNTRSVAELVIGELLLLLRGVPEANAKAHRGVWNKLAAGSFEARGKKLGIIGYGHIGTQLGILAESLGMYVYFYDIENKLPLGNATQVQHLSDLLNMSDVVSLHVPENPSTKNMMGAKEISLMKPGSLLINASRGTVVDIPALCDALASKHLAGAAIDVFPTEPATNSDPFTSPLCEFDNVLLTPHIGGSTQEAQENIGLEVAGKLIKYSDNGSTLSAVNFPEVSLPLHGGRRLMHIHENRPGVLTALNKIFAEQGVNIAAQYLQTSAQMGYVVIDIEADEDVAEKALQAMKAIPGTIRARLLY

SEQ ID NO: 229 - DNA, 1089 bp, Escherichia coli
atggctcaaatcttcaattttagttctggtccggcaatgctaccggcagaggtgcttaaacaggctcaacaggaactgcgcgactggaacggtcttggtacgtcggtgatggaagtgagtcaccgtggcaaagagttcattcaggttgcagaggaagccgagaaggattttcgcgatcttcttaatgtcccctccaactacaaggtattattctgccatggcggtggtcgcggtcagtttgctgcggtaccgctgaatattctcggtgataaaaccaccgcagattatgttgatgccggttactgggcggcaagtgccattaaagaagcgaaaaaatactgcacgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaagcgaacggcggtgtagctgaaatggataaaatcaatcagcaaaaagcagaactgctatatggggtgattgataacagcgatttctaccgcaatgacgtggcgaaagctaaccgttcgcggatgaacgtgccgttccagttggcggacagtgcgcttgacaaattgttccttgaagagtcttttgctgctggccttcatgcactgaaaggtcaccgtgtggtcggcggaatgcgcgcttctatttataacgccatgccgctggaaggcgttaaagcgctgacagacttcatggttgagttcgaacgccgtcacggttaa

SEQ ID NO: 230 - protein, 362 aa, Escherichia coli
MAQIFNFSSGPAMLPAEVLKQAQQELRDWNGLGTSVMEVSHRGKEFIQVAEEAEKDFRDLLNVPSNYKVLFCHGGGRGQFAAVPLNILGDKTTADYVDAGYWAASAIKEAKKYCTPNVFDAKVTVDGLRAVKPMREWQLSDNAAYMHYCPNETIDGIAIDETPDFGADVVVAADFSSTILSRPIDVSRYGVIYAGAQKNIGPAGLTIVIVREDLLGKANIACPSILDYSILNDNGSMFNTPPTFAWYLSGLVFKWLKANGGVAEMDKINQQKAELLYGVIDNSDFYRNDVAKANRSRMNVPFQLADSALDKLFLEESFAAGLHALKGHRVVGGMRASIYNAMPLEGVKALTDFMVEFERRHG

SEQ ID NO: 231 - DNA, 579 bp, Escherichia coli
gtggaataccgtagcctgacgcttgatgattttttatcgcgctttcaacttttgcgcccgcaaattaaccgggaaaccctaaatcatcgtcaggctgctgtgttaatccccatcgtccgtcgaccgcaaccggggttgttgctgactcagcgttcgattcatctgcgtaaacacgctggacaagtggcattccctggaggtgcagtcgatgacacggacgcatcagctatcgccgccgcgctgcgcgaagctgaagaagaggtcgctataccgccttccgccgttgaagttatcggcgtgctgccgcccgtcgatagcgtcactggctaccaggtaaccccagtggtcggcattatcccgcccgatctgccgtatcgcgccagtgaagatgaagtctcggcggtgtttgaaatgccgctcgcccaggcattacatctgggtcgttatcaccctttagatatctaccgccgtggtgattcacatcgggtatggctgtcctggtacgaacagtattttgtatggggaatgaccgcaggcataattcgtgagctggcgctgcaaattggtgtgaaaccctga

SEQ ID NO: 232 - protein, 192 aa, Escherichia coli
MEYRSLTLDDFLSRFQLLRPQINRETLNHRQAAVLIPIVRRPQPGLLLTQRSIHLRKHAGQVAFPGGAVDDTDASAIAAALREAEEEVAIPPSAVEVIGVLPPVDSVTGYQVTPVVGIIPPDLPYRASEDEVSAVFEMPLAQALHLGRYHPLDIYRRGDSHRVWLSWYEQYFVWGMTAGIIRELALQIGVKP

SEQ ID NO: 233 - DNA, 969 bp, Escherichia coli
atgcctaacattacctggtgcgacctgcctgaagatgtctctttatggccgggtctgcctctttcattaagtggtgatgaagtgatgccactggattaccacgcaggtcgtagcggctggctgctgtatggtcgtgggctggataaacaacgtctgacccaataccagagcaaactgggtgcggcgatggtgattgttgccgcctggtgcgtggaagattatcaggtgattcgtctggcaggttcactcaccgcacgggctacacgcctggcccacgaagcgcagctggatgtcgccccgctggggaaaatcccgcacctgcgcacgccgggtttgctggtgatggatatggactccaccgccatccagattgaatgtattgatgaaattgccaaactggccggaacgggcgagatggtggcggaagtaaccgaacgggcgatgcgcggcgaactcgattttaccgccagcctgcgcagccgtgtggcgacgctgaaaggcgctgacgccaatattctgcaacaggtgcgtgaaaatctgccgctgatgccaggcttaacgcaactggtgctcaagctggaaacgctgggctggaaagtggcgattgcctccggcggctttactttctttgctgaatacctgcgcgacaagctgcgcctgaccgccgtggtagccaatgaactggagatcatggacggtaaatttaccggcaatgtgatcggcgacatcgtagacgcgcagtacaaagcgaaaactctgactcgcctcgcgcaggagtatgaaatcccgctggcgcagaccgtggcgattggcgatggagccaatgacctgccgatgatcaaagcggcagggctggggattgcctaccatgccaagccaaaagtgaatgaaaaggcggaagtcaccatccgtcacgctgacctgatgggggtattctgcatcctctcaggcagcctgaatcagaagtaa

SEQ ID NO: 234 - protein, 322 aa, Escherichia coli [sequence omitted]

SEQ ID NO: 235 - DNA, 2233 bp, Arabidopsis thaliana
cgaaagggcaaaaaccaaaaagagaatcaaattttgcctcttctatataaatcaaatcaacgacgaagcgtcgctctcgttttctgtgtgtctctctctttgtcccaccattttcaccgcttctcctccaatcactcagatctacagattcctttaaaacaacaatggttggatctttggaatctgatcaaactctttcaatggccaccttaatcgaaaaactcgacatcttatctgacgacttcgatccaaccgccgtagtcaccgaaccgttacctcctccggtaactaatggaatcggagctgataaaggaggaggaggaggagaaagagagatggttctcggtaggaatatacacacaacgtcactcgctgtaacggaaccggaggttaacgatgaattcaccggagataaagaagcttatatggctagtgttcttgctcgttaccggaaaactttggttgaacgaaccaaaaaccatttaggtaaaatttgatctgatctgatctttttttttgaatcggaatcggaatctgaatcggaatctggtgtaggttatccttataacttggatttcgactatggtgcgcttggtcagttacaacatttttcgattaataatcttggagatccgtttattgaaagtaactatggtgtacactcaagaccttttgaagttggtgtgttggattggtttgctcgtctttgggagattgagagagatgattattggggttacattaccaattgtggtactgaaggcaaccttcatggcattttagtcgggtacgtttttcgaaaatcatcggtgttttgattcattcgaaaaaccgaaaaaaaacggtgtttgatttgatgtgtgtttgtaggagggagatgtttccggatgggatattgtatgcgtcgcgtgaatcgcattactcggtgtttaaagctgctcgaatgtatcgaatggagtgtgagaaggttgatacgcttatgtcaggggagattgattgtgatgatttgaggaagaagttgttggctaataaagataaaccggcgattcttaatgttaacataggttggtttatgttttagtactttggctttgtttgttgtgttaggattggtgctaatggttgaaatcttgttttctttaggaacgacggttaaaggagctgttgatgatcttgaccttgttatcaaaactcttgaagagtgtggtttctcacatgataggttctatattcattgtgatggagctttgtttggacttatgatgccttttgtcaaacgtgtaagtgtatagtcttcagtctaagcgaaatcgttatgataatctttgttctgctctgagatttgttgttttatctcctctgtaggcaccgaaagtgacgtttaataaaccgatagggagtgtgagtgtatcgggccacaaatttgtcgggtgtccaatgccatgtggtgttcagataacaagaatggaacatatcaaagtcctctccagtaacgttgagtaccttgcttcaagggatgcaacaatcatgggaagtcgtaacgggcatgctcctttgttcctctggtacaccttaaacaggaaaggttacaaaggattccagaaagaagttcagaaatgcttgagaaacgcgcattacctcaaagaccgacttcgtgaagctgggattagcgccatgcttaatgagcttagcagcactgtggtctttgaacggcctaaagatgaagagtttgttagaaggtggcagcttgcttgccaaggtgatatagctcatgtggtggttatgccaagtgttacaatcgagaagcttgataatttcctgaaagaccttgtcaaacacagattgatctggtacgaggatggatctcagcctccttgccttgcatcggaggtaggaaccaacaactgcatctgtccagctcacaagtgacggcaccatttctcatttgttggtattgttgttttctagtaagccacatctagtttaaattcctcatcactgtattcctgaacttggtttcaatcatcgtaaaattttgtcagtttctcttatttacaagttaaggtttcaaacagtgtttacaatttgtagctcaatctggagcatgatcaaccttcacttcgtcgttcgcaatcgtttaccgagttttagcattatcgtaacagcaagtatgtgccttaagccgctgatttagctgcgtgtttgatgatcggtgcttaatgcctaggaaaag

SEQ ID NO: 236 - protein, 482 aa, Arabidopsis thaliana
MVGSLESDQTLSMATLIEKLDILSDDFDPTAVVTEPLPPPVTNGIGADKGGGGGEREMVLGRNIHTTSLAVTEPEVNDEFTGDKEAYMASVLARYRKTLVERTKNHLGYPYNLDFDYGALGQLQHFSINNLGDPFIESNYGVHSRPFEVGVLDWFARLWEIERDDYWGYITNCGTEGNLHGILVGREMFPDGILYASRESHYSVFKAARMYRMECEKVDTLMSGEIDCDDLRKKLLANKDKPAILNVNIGTTVKGAVDDLDLVIKTLEECGFSHDRFYIHCDGALFGLMMPFVKRAPKVTFNKPIGSVSVSGHKFVGCPMPCGVQITRMEHIKVLSSNVEYLASRDATIMGSRNGHAPLFLWYTLNRKGYKGFQKEVQKCLRNAHYLKDRLREAGISAMLNELSSTVVFERPKDEEFVRRWQLACQGDIAHVVVMPSVTIEKLDNFLKDLVKHRLIWYEDGSQPPCLASEVGTNNCICPAHK

SEQ ID NO: 237 - DNA, 2274 bp, Escherichia coli
atgggaagcccctctctgtattctgcccgtaaaacaaccctggcgttggcagtcgccttaagtttcgcctggcaagcgccggtatttgcccacggtggtgaagcgcatatggtgccaatggataaaacgcttaaagaatttggtgccgatgtgcagtgggacgactacgcccagctctttaccctgattaaagatggcgcgtacgtgaaagtgaagcctggtgcgcaaacagcaattgttaatggtcagcctctggcactgcaagtaccggtagtgatgaaagacaataaagcctgggtttctgacacctttattaacgatgttttccagtccgggctggatcaaacctttcaggtagaaaagcgccctcacccacttaatgcgctaactgcggacgaaattaaacaggccgttgaaattgttaaagcttccgcggacttcaaacccaatacccgttttactgagatctccctgctaccgccagataaagaagctgtctgggcgtttgcgctggaaaacaaaccggttgaccagccgcgcaaagccgacgtcattatgctcgacggcaaacatatcatcgaagcggtggtggatctgcaaaacaacaaactgctctcctggcaacccattaaagacgcccacggtatggtgttgctggatgatttcgccagtgtgcagaacattattaacaacagtgaagaatttgccgctgccgtgaagaaacgcggtattactgatgcgaaaaaagtgattaccacgccgctgaccgtaggttatttcgatggtaaagatggcctgaaacaagatgcccggttgctcaaagtcatcagctatcttgatgtcggtgatggcaactactgggcacatcccatcgaaaacctggtggcggtcgttgatttagaacagaaaaaaatcgttaagattgaagaaggtccggtagttccggtgccaatgaccgcacgcccatttgatggccgtgaccgcgttgctccggcagttaagcctatgcaaatcattgagcctgaaggtaaaaattacaccattactggcgatatgattcactggcggaactgggattttcacctcagcatgaactctcgcgtcgggccgatgatctccaccgtgacttataacgacaatggcaccaaacgcaaagtcatgtacgaaggttctctcggcggcatgattgtgccttacggtgatcctgatattggctggtactttaaagcgtatctggactctggtgactacggtatgggcacgctaacctcaccaattgctcgtggtaaagatgccccgtctaacgcagtgctccttaatgaaaccatcgccgactacactggcgtgccgatggagatccctcgcgctatcgcggtatttgaacgttatgccgggccggagtataagcatcaggaaatgggccagcccaacgtcagtaccgaacgccgggagttagtggtgcgctggatcagtacagtgggtaactatgactacatttttgactggatcttccatgaaaacggcactattggcatcgatgccggtgctacgggcatcgaagcggtgaaaggtgttaaagcgaaaaccatgcacgatgagacggcgaaagatgacacgcgctacggcacgcttatcgatcacaatatcgtgggtactacacaccaacatatttataatttccgcctcgatctggatgtagatggcgagaataacagcctggtggcgatggacccagtggtaaaaccgaatactgccggtggcccacgcaccagtaccatgcaagttaatcagtacaacatcggcaatgaacaggatgccgcacagaaatttgatccgggcacgattcgtctgttgagtaacccgaacaaagagaaccgcatgggcaatccggtttcctatcaaattattccttatgcaggtggtactcacccggtagcaaaaggtgcccagttcgcgccggacgagtggatctatcatcgtttaagctttatggacaagcagctctgggtaacgcgttatcatcctggcgagcgtttcccggaaggcaaatatccgaaccgttctactcatgacaccggtcttggacaatacagtaaggataacgagtcgctggacaacaccgacgccgttgtctggatgaccaccggcaccacacatgtggcccgcgccgaagagtggccgattatgccgaccgaatgggtacatactctgctgaaaccatggaacttctttgacgaaacgccaacgctaggggcgctgaagaaagataagtga

SEQ ID NO: 238 - protein, 757 aa, Escherichia coli
MGSPSLYSARKTTLALAVALSFAWQAPVFAHGGEAHMVPMDKTLKEFGADVQWDDYAQLFTLIKDGAYVKVKPGAQTAIVNGQPLALQVPVVMKDNKAWVSDTFINDVFQSGLDQTFQVEKRPHPLNALTADEIKQAVEIVKASADFKPNTRFTEISLLPPDKEAVWAFALENKPVDQPRKADVIMLDGKHIIEAVVDLQNNKLLSWQPIKDAHGMVLLDDFASVQNIINNSEEFAAAVKKRGITDAKKVITTPLTVGYFDGKDGLKQDARLLKVISYLDVGDGNYWAHPIENLVAVVDLEQKKIVKIEEGPVVPVPMTARPFDGRDRVAPAVKPMQIIEPEGKNYTITGDMIHWRNWDFHLSMNSRVGPMISTVTYNDNGTKRKVMYEGSLGGMIVPYGDPDIGWYFKAYLDSGDYGMGTLTSPIARGKDAPSNAVLLNETIADYTGVPMEIPRAIAVFERYAGPEYKHQEMGQPNVSTERRELVVRWISTVGNYDYIFDWIFHENGTIGIDAGATGIEAVKGVKAKTMHDETAKDDTRYGTLIDHNIVGTTHQHIYNFRLDLDVDGENNSLVAMDPVVKPNTAGGPRTSTMQVNQYNIGNEQDAAQKFDPGTIRLLSNPNKENRMGNPVSYQIIPYAGGTHPVAKGAQFAPDEWIYHRLSFMDKQLWVTRYHPGERFPEGKYPNRSTHDTGLGQYSKDNESLDNTDAVVWMTTGTTHVARAEEWPIMPTEWVHTLLKPWNFFDETPTLGALKKDK

SEQ ID NO: 239 - DNA, 1218 bp, Escherichia coli
atgtcccccattgaaaaatccagcaaattagagaatgtctgttatgacatccgtggtccggtgctgaaagaagcaaaacgcctggaagaagaaggtaacaaggtactgaaactgaacatcggcaacccagccccgttcggttttgacgcgccagatgaaatcctcgttgacgtgatacgcaacctgcctaccgctcaagggtattgcgattccaaaggtctttactccgcgcgtaaagccatcatgcagcactaccaggctcgtggcatgcgtgatgttaccgtggaagatatttacatcggcaatggtgtatcggagcttatcgttcaggcaatgcaggcattgctgaacagcggggacgaaatgttggttcctgcaccagattacccactctggaccgcggcggtttcgctttccagcggtaaagcggtgcattatctttgcgatgaatcctctgactggttcccggacctcgatgatattcgcgctaaaattacgcctcgtacgcgtgggatcgttattatcaacccaaataacccaaccggcgcggtatattccaaagagcttttaatggagattgtggagattgcacgtcagcataatctcattatcttcgccgatgaaatttatgacaaaattctctacgacgacgctgagcatcactcaattgcgccgctggcacctgacctgctgaccattacctttaacggactgtcgaaaacgtaccgcgttgcaggcttccgtcaggggtggatggtgttgaacgggccgaaaaaacacgccaaaggctacatcgaaggtctggaaatgctggcttcaatgcgcctgtgtgctaacgttcctgcgcaacacgccattcagaccgcgctaggtggttatcagagcatcagtgaatttattacccctggcggtcgtctttatgagcagcgtaaccgcgcgtgggaactgatcaacgatattccgggcgtttcctgcgtgaaacctcgtggtgcgctgtatatgttcccgaaaatcgacgccaaacgctttaacattcacgacgatcagaaaatggtgttggatttcctgttgcaggaaaaagttctgttggtgcaagggacggcattcaactggccgtggccggatcacttccgcattgtcacgctaccgcgtgtcgatgatatcgagctgtctttgagcaagttcgcgcgtttcctttctggttatcatcagctgtaa

SEQ ID NO: 240 - protein, 405 aa, Escherichia coli
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 241 - DNA, 975 bp, Escherichia coli
atgaagccgtccgttatcctctacaaagccttacctgatgatttactgcaacgcctgcaagagcatttcaccgttcaccaggtggcaaacctcagcccacaaaccgtcgaacaaaatgcagcaatttttgccgaagctgaaggtttactgggttcaaacgagaatgtaaatgccgcattgctggaaaaaatgccgaaactgcgtgccacatcaacgatctccgtcggctatgacaattttgatgtcgatgcgcttaccgcccgaaaaattctgctgatgcacacgccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggcatggcgctggcacaacgtgcgcactttggcttcaacatgcccatcctctataacgcgcgccgccaccataaagaagcagaagaacgcttcaacgcccgctactgcgatttggatactctgttacaagagtcagatttcgtttgcctgatcctgccgttaactgatgagacgcatcatctgtttggcgcagaacaattcgccaaaatgaaatcctccgccattttcattaatgccggacgtggcccggtggttgacgaaaatgcactgatcgcagcattgcagaaaggcgaaattcacgctgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgagaagaactgtgtgaatccgcacgtcgcggactaa

SEQ ID NO: 242 - protein, 324 aa, Escherichia coli
MKPSVILYKALPDDLLQRLQEHFTVHQVANLSPQTVEQNAAIFAEAEGLLGSNENVNAALLEKMPKLRATSTISVGYDNFDVDALTARKILLMHTPTVLTETVADTLMALVLSTARRVVEVAERVKAGEWTASIGPDWYGTDVHHKTLGIVGMGRIGMALAQRAHFGFNMPILYNARRHHKEAEERFNARYCDLDTLLQESDFVCLILPLTDETHHLFGAEQFAKMKSSAIFINAGRGPVVDENALIAALQKGEIHAAGLDVFEQEPLSVDSPLLSMANVVAVPHIGSATHETRYGMAACAVDNLIDALQGKVEKNCVNPHVAD

SEQ ID NO: 243 - DNA, 1179 bp, Homo sapiens
atggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtga

SEQ ID NO: 244 - protein, 392 aa, Homo sapiens
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 245 - DNA, 10 bp, Escherichia coli
aaaaaaaaaa

SEQ ID NO: 246 - protein, 6 aa, Escherichia coli
LANFWG

SEQ ID NO: 247 - DNA, 10 bp, Arabidopsis thaliana
aaaaaaaaaa

SEQ ID NO: 248 - protein, 5 aa, Arabidopsis thaliana
FVKDP

SEQ ID NO: 249 - DNA, 1146 bp, Escherichia coli
atgaagattgtcattgcgccagactcttttaaagagagcttaagtgcagaaaaatgttgtcaggcaattaaagccgggttttcgaccctctttcccgatgcgaactatatctgtttgccgatagcggatggcggcgaagggacggtggatgcgatggtcgccgcgacgggcggcaacatcgtgacgcttgaagtctgcgggccgatgggcgaaaaagtgaatgctttttatggccttaccggcgacgggaaaacggcggtgattgagatggcggcagcaagtggcctgatgctggtcgcgcctgaaaagcgtaatccgttgctggcctccagttttggtacgggggagttaattcgtcatgcgctggataacgacattcgccatattattctcggcattggcggcagtgcgacggtcgacggcggtatgggcatggcgcaggcgctcggtgtgcgtttccttgatgccgacggtcaggcgctggcggcaaacggtggtaatttagcgcgcgtggcaagcattgagatggatgaatgcgatccgcgtctggcgaattgccatattgaagtagcatgtgacgttgataacccgctggtaggggcacgcggcgcggcggcggtgtttggcccgcaaaaaggggcaacgccggagatggtcgaagaacttgaacaggggctgcaaaattacgcccgtgttttacaacagcaaactgaaattaatgtctgccagatggcgggcggcggcgctgcgggcggtatgggtattgcggcggcggtatttctcaatgcggatattaaaccgggcattgaaattgtgttgaatgcggtcaatcttgcgcaggcagtgcagggcgcagcactggtgattaccggggaagggcgcatcgactcgcaaacggcaggcggtaaagcgccgctgggtgtggcgtcggtggcgaagcagtttaatgtaccggtgattgggattgctggcgtattgggtgatggcgtggaagtggtgcaccagtacggcattgacgcggtattcagcattttgcctcgtctggcacctttagccgaagtgctcgccagcggtgaaaccaatctcttcaacagcgcgcgaaatattgcctgcgccattaaaataggtcagggaattaaaaactaa

SEQ ID NO: 250 - protein, 381 aa, Escherichia coli
MKIVIAPDSFKESLSAEKCCQAIKAGFSTLFPDANYICLPIADGGEGTVDAMVAATGGNIVTLEVCGPMGEKVNAFYGLTGDGKTAVIEMAAASGLMLVAPEKRNPLLASSFGTGELIRHALDNDIRHIILGIGGSATVDGGMGMAQALGVRFLDADGQALAANGGNLARVASIEMDECDPRLANCHIEVACDVDNPLVGARGAAAVFGPQKGATPEMVEELEQGLQNYARVLQQQTEINVCQMAGGGAAGGMGIAAAVFLNADIKPGIEIVLNAVNLAQAVQGAALVITGEGRIDSQTAGGKAPLGVASVAKQFNVPVIGIAGVLGDGVEVVHQYGIDAVFSILPRLAPLAEVLASGETNLFNSARNIACAIKIGQGIKN

SEQ ID NO: 251 - DNA, 1146 bp, Escherichia coli
atgaaaatcgtaatcgccccagactcttataaagaaagtttatctgccagcgaggttgcgcaggcgatagaaaaaggatttcgggaaatttttcctgatgcacagtacgtttctgttccggttgccgacggtggcgaaggaacggtggaagcgatgattgcagccacccagggggctgaacgtcacgcctgggttacagggccgctgggcgagaaagtgaatgccagttgggggatctccggcgatggcaaaaccgcgtttattgaaatggcggcggccagtgggctggagctggtacctgcggaaaaacgcgatccactcgtgaccacttcacgcggcacaggcgagttaatcctgcaggcgctggagagcggtgcgacaaacattattatcggcattggcggcagcgctacaaatgatggcggcgcaggcatggtacaggcgctgggggcgaaattatgcgacgccaacggcaatgaaattggttttggcggcggtagtcttaatactctgaatgatattgatatttccggcctcgatccgcgcttaaaagattgcgtcattcgcgtcgcttgtgatgtcaccaatccgctggtgggcgataacggcgcatcgcgcatctttggcccacaaaagggagccagtgaagcgatgattgttgagctggacaataacctctctcactatgccgaggtcattaaaaaagcgctgcatgttgatgtgaaagatgtccccggtgcaggagctgcgggtggtatgggcgcggcgctaatggcgtttcttggtgcggaactgaaaagtggtattgaaatcgtcactacggcgctgaatctggaggaacatattcacgattgtacgctggtgatcaccggtgaagggcgtattgacagccagagtattcacgggaaggtaccgattggtgtcgcaaacgtggcgaagaagtaccataaaccggtgattggcattgcgggtagcctgaccgatgatgttggcgttgtacatcagcatggcattgatgcggtcttcagcgtattgaccagcataggtacgttggacgaagcattccgcggggcttatgacaatatctgccgtgcttcacgtaatatcgccgcgacactggcgattggaatgcgcaacgcggggtga

SEQ ID NO: 252 - protein, 381 aa, Escherichia coli
MKIVIAPDSYKESLSASEVAQAIEKGFREIFPDAQYVSVPVADGGEGTVEAMIAATQGAERHAWVTGPLGEKVNASWGISGDGKTAFIEMAAASGLELVPAEKRDPLVTTSRGTGELILQALESGATNIIIGIGGSATNDGGAGMVQALGAKLCDANGNEIGFGGGSLNTLNDIDISGLDPRLKDCVIRVACDVTNPLVGDNGASRIFGPQKGASEAMIVELDNNLSHYAEVIKKALHVDVKDVPGAGAAGGMGAALMAFLGAELKSGIEIVTTALNLEEHIHDCTLVITGEGRIDSQSIHGKVPIGVANVAKKYHKPVIGIAGSLTDDVGVVHQHGIDAVFSVLTSIGTLDEAFRGAYDNICRASRNIAATLAIGMRNAG

SEQ ID NO: 253 - DNA, 450 bp, Escherichia coli
atgaaaaagattgcatttggctgtgatcatgtcggtttcattttaaaacatgaaatagtggcacatttagttgagcgtggcgttgaagtgattgataaaggaacctggtcgtcagagcgtactgattatccacattacgccagtcaagtcgcactggctgttgctggcggagaggttgatggcgggattttgatttgtggtactggcgtcggtatttcgatagcggcgaacaagtttgccggaattcgcgcggtcgtctgtagcgaaccttattccgcgcaactttcgcggcagcataacgacaccaacgtgctggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattga

SEQ ID NO: 254 - protein, 149 aa, Escherichia coli
MKKIAFGCDHVGFILKHEIVAHLVERGVEVIDKGTWSSERTDYPHYASQVALAVAGGEVDGGILICGTGVGISIAANKFAGIRAVVCSEPYSAQLSRQHNDTNVLAFGSRVVGLELAKMIVDAWLGAQYEGGRHQQRVEAITAIEQRRN

SEQ ID NO: 255 - DNA, 780 bp, Escherichia coli
atgactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatctgtatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaa

SEQ ID NO: 256 - protein, 259 aa, Escherichia coli
MTDLKASSLRALKLMDLTTLNDDDTDEKVIALCHQAKTPVGNTAAICIYPRFIPIARKTLKEQGTPEIRIATVTNFPHGNDDIDIALAETRAAIAYGADEVDVVFPYRALMAGNEQVGFDLVKACKEACAAANVLLKVIIETGELKDEALIRKASEISIKAGADFIKTSTGKVAVNATPESARIMMEVIRDMGVEKTVGFKPAGGVRTAEDAQKYLAIADELFGADWADARHYRFGASSLLASLLKALGHGDGKSASSY

SEQ ID NO: 257 - DNA, 41 bp, Artificial Sequence
  EcDERA C47N Primer 1
cggcaataccgccgctatcaatatctatcctcgctttatcc

SEQ ID NO: 258 - DNA, 41 bp, Artificial Sequence
  EcDERA C47N Primer 2
ggataaagcgaggatagatattgatagcggcggtattgccg

SEQ ID NO: 259 - DNA, 33 bp, Artificial Sequence
  EcDERA K201N Primer 1
gtagaaaaaaccgttggtttcaacccggcgggc

SEQ ID NO: 260 - DNA, 33 bp, Artificial Sequence
  EcDERA K201N Primer 2
gcccgccgggttgaaaccaacggttttttctac

SEQ ID NO: 261 - DNA, 30 bp, Artificial Sequence
  BcDERA C37N Primer 1
cttcgcggcggtgaacgttaacccgacctg

SEQ ID NO: 262 - DNA, 30 bp, Artificial Sequence
  BcDERA C37N Primer 2
caggtcgggttaacgttcaccgccgcgaag

SEQ ID NO: 263 - DNA, 25 bp, Artificial Sequence
  BcDERA K181N Primer 1
gcgggtgtgaacgcgagcggcggtg

SEQ ID NO: 264 - DNA, 25 bp, Artificial Sequence
  BcDERA K181N Primer 2
caccgccgctcgcgttcacacccgc

SEQ ID NO: 265 - DNA, 27 bp, Artificial Sequence
  E. Coli rbsK Primer 1
taagcaccatggcaatgcaaaacgcag

SEQ ID NO: 266 - DNA, 32 bp, Artificial Sequence
  E. Coli rbsK Primer 2
tgcttaaagcttcctctgcctgtctaaaaatg

SEQ ID NO: 267 - DNA, 37 bp, Artificial Sequence
  T. meritima XuK Primer 1
aggagatataccatggtggaagcggtgattttcgaca

SEQ ID NO: 268 - DNA, 40 bp, Artificial Sequence
  T. maritima XuK Primer 2
gtgcggccgcaagcttaagaacctctttgagaacgttcag

SEQ ID NO: 269 - DNA, 19 bp, Artificial Sequence
  E. coli AraB Primer 1
atggcgattgcaattggcc

SEQ ID NO: 270 - DNA, 30 bp, Artificial Sequence
  E. Coli AraB Primer 2
cgaattcgttatagagtcgcaacggcctgg

SEQ ID NO: 271 - DNA, 30 bp, Artificial Sequence
  E. coli aldA Primer 1
catatgtcagtacccgttcaacatcctatg

SEQ ID NO: 272 - DNA, 37 bp, Artificial Sequence
  E. Coli aldA Primer 2
gaattcgttaagactgtaaataaaccacctgggtctg

SEQ ID NO: 273 - DNA, 41 bp, Artificial Sequence; identical to SEQ ID NO: 257
  EcDERA C47N Foward Primer for Site Directed Mutagenesis

SEQ ID NO: 274 - DNA, 41 bp, Artificial Sequence; identical to SEQ ID NO: 258
  EcDERA C47N Reverse Primer for Site Directed Mutagenesis

SEQ ID NO: 275 - DNA, 45 bp, Artificial Sequence
  pZS2_J23101_J23119 FW
cgccccagctggcaattccgactaagaaacacagctaacaccacg

SEQ ID NO: 276 - DNA, 56 bp, Artificial Sequence
  pZS2_J23101_RV
gtggtggtacgcgtaccatgggatcggtaccgctagcataatacctaggactgagc

SEQ ID NO: 277 - DNA, 56 bp, Artificial Sequence
  pZS2_J23119_RV
gtggtggtacgcgtaccatgggatcggtaccgctagcattatacctaggactgagc

SEQ ID NO: 278 - DNA, 35 bp, Artificial Sequence
  pZA2_MCS_ori_FW
tcgaggtcgacggtatcgataagcttgatatcgaa

SEQ ID NO: 279 - DNA, 29 bp, Artificial Sequence
  pZA2_MCS_ori_RV
agctcgcttggactcctgttgatagatcc

SEQ ID NO: 280 - DNA, 33 bp, Artificial Sequence
  pZS2_Kan_Promoter_FW
gagtccaagcgagctctcgaaccccagagtccc

SEQ ID NO: 281 - DNA, 37 bp, Artificial Sequence
  pZS2_Kan_J23101_FW
taccgtcgacctcgacggtaccgctagcataatacct

SEQ ID NO: 282 - DNA, 37 bp, Artificial Sequence
  pZS2_Kan_J23119_RV
taccgtcgacctcgacggtaccgctagcattatacct

SEQ ID NO: 283 - DNA, 82 bp, Artificial Sequence
  DERA_assembly_J23101_RV
ggtattatgctagcgtaatagaaataattttgtttaactttaaggaggtttggaatggcaactgatctgaaagcaagcagcc

SEQ ID NO: 284 - DNA, 82 bp, Artificial Sequence
  DERA_assembly_J23119_RV
ggtataatgctagcgtaatagaaataattttgtttaactttaaggaggtttggaatggcaactgatctgaaagcaagcagcc

SEQ ID NO: 285 - DNA, 40 bp, Artificial Sequence
  DERA_assembly_RV
ccgtcgacctcgacgttagtagctgctggcgctcttaccg

SEQ ID NO: 286 - DNA, 672 bp, Bacillus caldolyticus DERA
atgacgatgaatatcgcgaaaatgatcgatcatacgctgctcaaaccggaagcgacagaacaacaaatcgtgcaactgtgcacggaagcaaagcaatacggctttgctgccgtgtgcgtcaacccaacgtgggtgaaaacggcggcgcgcgagctttccggcacggatgtccgcgtctgcacggtcatcggctttccacttggggcaacgacgccggaaacaaaggcgtttgaaacaacgaacgccatcgaaaacggcgctcgcgaagtcgacatggtgatcaacatcggtgcgttaaaaagcgggcaagacgagcttgtcgagcgcgacattcgtgcggttgtcgaagcggcggctggcagggcgcttgtcaaagtgatcgttgaaacggcgcttttgaccgatgaggaaaaagtgcgcgcctgccagctcgcagtgaaagccggcgctgattatgtgaaaacgtcgaccgggttttccggcggaggtgcgacggtggaggatgtggcgctgatgcggaaaacggtcggcgacagagcaggcgtcaaagcatcaggcggcgtccgtgactggaaaaccgctgaggcgatgatcaacgccggcgcgacgcgcatcggcacaagctctggggtggcgatcgtcaccggcgggacgggccgcgctgactactaa

SEQ ID NO: 287 - DNA, 674 bp, Artificial Sequence
  cDNA optimized sequence for BcDERA
ccatggcaaacatcgcgaagatgattgaccacaccctgctgaaaccggaggcgaccgaacagcaaatcgttcagctgtgcaccgaggcgaaacaatacggcttcgcggcggtgtgcgttaacccgacctgggttaagaccgcggcgcgtgaactgagcggtaccgacgtgcgtgtttgcaccgtgattggtttcccgctgggtgcgaccaccccggagaccaaagcgtttgaaaccaccaacgcgattgagaacggcgcgcgtgaagttgatatggtgatcaacattggcgcgctgaagagcggtcaggacgagctggttgagcgtgatattcgtgcggtggttgaggctgcggcgggtcgtgcgctggtgaaagttattgtggaaaccgcgctgctgaccgacgaggaaaaagtgcgtgcgtgccaactggcggttaaggcgggtgcggattacgtgaaaaccagcaccggttttagcggtggcggtgcgaccgttgaggatgtggcgctgatgcgtaagaccgttggcgatcgtgcgggtgtgaaagcgagcggcggtgttcgtgactggaagaccgcggaagcgatgatcaacgcgggtgcgacccgtattggtaccagcagcggtgttgcgattgtgaccggcggtaccggtcgtgcggattataagctt

SEQ ID NO: 288 - DNA, 1701 bp, Escherichia coli AraB
atggcgattgcaattggcctcgattttggcagtgattctgtgcgagctttggcggtggactgcgctaccggtgaagagatcgccaccagcgtagagtggtatccccgttggcagaaagggcaattttgtgatgccccgaataaccagttccgtcatcatccgcgtgactacattgagtcaatggaagcggcactgaaaaccgtgcttgcagagcttagcgtcgaacagcgcgcagctgtggtcgggattggcgttgacagtaccggctcgacgcccgcaccgattgatgccgacggaaacgtgctggcgctgcgcccggagtttgccgaaaacccgaacgcgatgttcgtattgtggaaagaccacactgcggttgaagaagcggaagagattacccgtttgtgccacgcgccgggcaacgttgactactcccgctacattggtggtatttattccagcgaatggttctgggcaaaaatcctgcatgtgactcgccaggacagcgccgtggcgcaatctgccgcatcgtggattgagctgtgcgactgggtgccagctctgctttccggtaccacccgcccgcaggatattcgtcgcggacgttgcagcgccgggcataaatctctgtggcacgaaagctggggcggcctgccgccagccagtttctttgatgagctggacccgatcctcaatcgccatttgccttccccgctgttcactgacacttggactgccgatattccggtgggcaccttatgcccggaatgggcgcagcgtctcggcctgcctgaaagcgtggtgatttccggcggcgcgtttgactgccatatgggcgcagttggcgcaggcgcacagcctaacgcactggtaaaagttatcggtacttccacctgcgacattctgattgccgacaaacagagcgttggcgagcgggcagttaaaggtatttgcggtcaggttgatggcagcgtggtgcctggatttatcggtctggaagcaggccaatcggcgtttggtgatatctacgcctggtttggtcgcgtactcggctggccgctggaacagcttgccgcccagcatccggaactgaaaacgcaaatcaacgccagccagaaacaactgcttccggcgctgaccgaagcatgggccaaaaatccgtctctggatcacctgccggtggtgctcgactggtttaacggccgccgcacaccgaacgctaaccaacgcctgaaaggggtgattaccgatcttaacctcgctaccgacgctccgctgctgttcggcggtttgattgctgccaccgcctttggcgcacgcgcaatcatggagtgctttaccgatcaggggatcgccgttaataacgtgatggcactgggcggcatcgcgcggaaaaaccaggtcattatgcaggcctgctgcgacgtgctgaatcgcccgctgcaaattgttgcctctgaccagtgctgtgcgctcggtgcggcgatttttgctgccgtcgccgcgaaagtgcacgcagacatcccatcagctcagcaaaaaatggccagtgcggtagagaaaaccctgcaaccgtgcagcgagcaggcacaacgctttgaacagctttatcgccgctatcagcaatgggcgatgagcgccgaacaacactatcttccaacttccgccccggcacaggctgcccaggccgttgcgactctataa

SEQ ID NO: 289 - DNA, 1440 bp, Escherichia coli aldA
atgtcagtacccgttcaacatcctatgtatatcgatggacagtttgttacctggcgtggagacgcatggattgatgtggtaaaccctgctacagaggctgtcatttcccgcatacccgatggtcaggccgaggatgcccgtaaggcaatcgatgcagcagaacgtgcacaaccagaatgggaagcgttgcctgctattgaacgcgccagttggttgcgcaaaatctccgccgggatccgcgaacgcgccagtgaaatcagtgcgctgattgttgaagaagggggcaagatccagcagctggctgaagtcgaagtggcttttactgccgactatatcgattacatggcggagtgggcacggcgttacgagggcgagattattcaaagcgatcgtccaggagaaaatattcttttgtttaaacgtgcgcttggtgtgactaccggcattctgccgtggaacttcccgttcttcctcattgcccgcaaaatggctcccgctcttttgaccggtaataccatcgtcattaaacctagtgaatttacgccaaacaatgcgattgcattcgccaaaatcgtcgatgaaataggccttccgcgcggcgtgtttaaccttgtactggggcgtggtgaaaccgttgggcaagaactggcgggtaacccaaaggtcgcaatggtcagtatgacaggcagcgtctctgcaggtgagaagatcatggcgactgcggcgaaaaacatcaccaaagtgtgtctggaattggggggtaaagcaccagctatcgtaatggacgatgccgatcttgaactggcagtcaaagccatcgttgattcacgcgtcattaatagtgggcaagtgtgtaactgtgcagaacgtgtttatgtacagaaaggcatttatgatcagttcgtcaatcggctgggtgaagcgatgcaggcggttcaatttggtaaccccgctgaacgcaacgacattgcgatggggccgttgattaacgccgcggcgctggaaagggtcgagcaaaaagtggcgcgcgcagtagaagaaggggcgagagtggcgttcggtggcaaagcggtagaggggaaaggatattattatccgccgacattgctgctggatgttcgccaggaaatgtcgattatgcatgaggaaacctttggcccggtgctgccagttgtcgcatttgacacgctggaagatgctatctcaatggctaatgacagtgattacggcctgacctcatcaatctatacccaaaatctgaacgtcgcgatgaaagccattaaagggctgaagtttggtgaaacttacatcaaccgtgaaaacttcgaagctatgcaaggcttccacgccggatggcgtaaatccggtattggcggcgcagatggtaaacatggcttgcatgaatatctgcagacccaggtggtttatttacagtcttaa

SEQ ID NO: 290 - DNA, 1869 bp, Escherichia coli rbsK
atgttgcaaggaattttagaaaccgtaccatctgacttgaaagatccgatatcattatggtttaagcaagaccgcaacccaaaaactatagaagaggtcaccgctctctgcaaaaaatccgactggaatgagttacacaaaagatttgattctagaattcagtttggcactgctggtttaagatcgcaaatgcaagctggctttagcaggatgaatactttagtagtcatacaagcgtctcagggattggcaacttatgtaagacaacagtttccagacaatttggtagctgttgtgggacacgatcatagattccattctaaggagttcgctagagctactgctgctgcatttcttttaaaaggatttaaggtacattatttgaatcctgaccacgaatttgttcatacccctttagttccctttgcagtggataagctaaaggcctccgttggcgtaatgataacagcaagtcacaacccaaaaatggataatggatataaagtatactattccaatggatgccaaatcattccacctcacgatcatgccatctctgattccattgacgcaaatttagaaccatgggccaatgtgtgggatttcgacgatgttctaaataaggctctcaaacaagggaaattgatgtattccagagaagaaatgctgaagttatatttagaggaggtttctaaaaatctggtagaaatcaacccattaaagcttgaagtaaaagccaaaccttggttcgtttacactccaatgcatggggttggatttgacattttcagcaccatcgtaaaaaaaacactgtgcctggtagaaggtaaggattacctatgtgttcctgaacaacaaaatccagatccttctttcccaactgttggatttcctaaccctgaagaaaaaggtgctttagacattggtataaacttggctgaaaaacatgacattgacttacttgttgccaacgaccctgacgctgatagattctctgttgctgttaaagatatgcagtcaggcgaatggcgacaactaacaggtaacgaaatcggttttctttttgcattttatgaatatcagaaatataaaagtatggacaaagaatttcagcacgttcatccgttggctatgttaaattcaacagtgtcttcacaaatgataaaaaaaatggcagaaatagaagggttccattatgaggatacattaacaggatttaagtggatcggaaatcgtgccatactcttggaaaagaaaggctattacgttccttttggattcgaggaagcaataggctacatgtttccagcaatggagcatgataaggatggtatcagtgcatccattgtcttcttgcaagcctactgtaagtggaaaatagaccacaatttggacccgctaaatgtcttagaaaatggcttcaaaaaatatggcgtgttcaaagagtacaatggctattatgtcgttccaaatccaactgttacaaaagatatatttgactacatcaggaatgtctacactcctgagggcgcgtcatatccttcatctattggtgaagaaatcgaagtactttactatcgagatttaaccactggttaccaatcggataccataaatcataaacctactctacccgtcgatcctacatcacaaatgataacagtatctgctagaccaagtaacggtagtgagaatgagcatatccgcttcactattcgcgggtccggaacagaaccaaaacttaaagtatatattgaagcttgcgcaaatgaagaacaaagagcctctttcttggcgaaattgacttggaatgtgctgagacgtgaatggtttagaccagatgaaatgaatatagttacaaaattttga

SEQ ID NO: 291 - DNA, 1479 bp, Thermotoga maritima MSB8 XuK
atgaacctgtacgtgggactcgatgtgggaacgaccggtgtcaagggaattcttgtgaacgagaagggagagattcttgcaacagcgaatgaaagactaaccatgttcactcctcagcctgcctgggcggagcaggatcccctctcctggtgggaggcggtgaaaaaaatactgaaaaacctctccgaaagatcgaaagaaatgggcggcaaaataagagcgatctctaccagcgggcagatgcacagtcttgtggcaatcgatgacaacggtaaagtcctgagaaacgctatcctctggtgcgatcagagaacatacaaagagtgcgaagaagccacccagatcctcggcggagaggaaaacgttctcaagctcgtcggaaatcccattttgcccggtttcacgctcccaaagatactctggatccgaaagcatgaacctgagatctacggaaaaatttcaaaaatcatgctgccaaaagatttcataaactacatgctcaccggtgaggtgaaaacggagcattccgacgcctccggaacggtgatgtacagtgtgtcaaagatggaatggaacaaggacgtattgaaagaactcaacataccggaaagtgttctcccagagataataccgtcgaacggcgtggttggaaatgtgaaacctgaagtagcgtcggatctcggtctctccgaagacacgcttgtgataggcggaggagccgacaacgcctgtgcagctcttggaatagccgtcgtagaaccgggtgacgtgatggtgagtcttggtacttcaggaaccgttctggcacccacaaaagggaatcagcccgatccaaagggtagagtacatttctttgcacacaccgttccagaaacaagataccacatgggtgtgatgctctccgctacctattcactggagtggttcaaggaaaaattcctgagcgaagattacgaaacaatcaacgaagaggtggataaaattcctgcaggatcaaacgggataatcttcctgccgtatctcaacggtgaaaggacaccacacagagatccattcgcgaggggtgttttcttcggtatatcctcgtacaacaccaagtgggatatggtgagagccatattcgaaggcgttgccttcggtatcaaagattcgttcgatatactgagagaactcaaggtggttctcaacagtgtgagaattacaggaggaggttcaaagagcagggtatggaacaaaatgctcgcagatatgacaggattgagaatacaaaaaccagccgtggatgaaggggcgtcttacggtgcagcgatcctcgcagtgtctggctcaatgggagaaaatcccgcgaaaatttcgaaagaatggtttcgcgtgaagagttacactgaccctgctgttgaaaacacagaaacctacgaaaaactacacgagaaattcaaaaaactctacacatctctcaaagagatgttcagatcttga

SEQ ID NO: 292 - DNA, 111 bp, Artificial Sequence
  J23101_promoter
ctaagaaacacagctaacaccacgtcgtccctatctgctgccctaggtctatgagtggttgctggataactttacagctagctcagtcctaggtattatgctagcggtacc

SEQ ID NO: 293 - DNA, 111 bp, Artificial Sequence
  J23119_promoter
ctaagaaacacagctaacaccacgtcgtccctatctgctgccctaggtctatgagtggttgctggataacttgacagctagctcagtcctaggtataatgctagcggtacc

SEQ ID NO: 294 - DNA, 780 bp, Artificial Sequence
  DERA_C47N_Escherichia_coli_MG1655
atgactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatcaatatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaa

SEQ ID NO: 295 - DNA, 3075 bp, Artificial Sequence
  pZA2-J23119-DERA
tcgaggtcgacggtatcgataagcttgatatcgaattcctgcagcccgggggatcccatggtacgcgtaccaccaccaccaccactgagatccggctgctaacaaagcccgaaaggaagctgagttggctgctgccaccgctgagcaataactagcacgcgtgctagaggcatcaaataaaacgaaaggctcagtcgaaagactgggcctttcgttttatctgttgtttgtcggtgaacgctctcctgagtaggacaaatccgccgccctagacctagggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatattactagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccgactaagaaacacagctaacaccacgtcgtccctatctgctgccctaggtctatgagtggttgctggataacttgacagctagctcagtcctaggtataatgctagcgtaatagaaataattttgtttaactttaaggaggtttggaatggcaactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatcaatatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaacg

SEQ ID NO: 296 - DNA, 3075 bp, Artificial Sequence
  pZA2-J23101-DERA
tcgaggtcgacggtatcgataagcttgatatcgaattcctgcagcccgggggatcccatggtacgcgtaccaccaccaccaccactgagatccggctgctaacaaagcccgaaaggaagctgagttggctgctgccaccgctgagcaataactagcacgcgtgctagaggcatcaaataaaacgaaaggctcagtcgaaagactgggcctttcgttttatctgttgtttgtcggtgaacgctctcctgagtaggacaaatccgccgccctagacctagggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatattactagatttcagtgcaatttatctcttcaaatgtagcacctgaagtcagccccatacgatataagttgttactagtgcttggattctcaccaataaaaaacgcccggcggcaaccgagcgttctgaacaaatccagatggagttctgaggtcattactggatctatcaacaggagtccaagcgagctctcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccgactaagaaacacagctaacaccacgtcgtccctatctgctgccctaggtctatgagtggttgctggataactttacagctagctcagtcctaggtattatgctagcgtaatagaaataattttgtttaactttaaggaggtttggaatggcaactgatctgaaagcaagcagcctgcgtgcactgaaattgatggacctgaccaccctgaatgacgacgacaccgacgagaaagtgatcgccctgtgtcatcaggccaaaactccggtcggcaataccgccgctatcaatatctatcctcgctttatcccgattgctcgcaaaactctgaaagagcagggcaccccggaaatccgtatcgctacggtaaccaacttcccacacggtaacgacgacatcgacatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccggcgggcggcgtgcgtactgcggaagatgcgcagaaatatctcgccattgcagatgaactgttcggtgctgactgggcagatgcgcgtcactaccgctttggcgcttccagcctgctggcaagcctgctgaaagcgctgggtcacggcgacggtaagagcgccagcagctactaacg

SEQ ID NO: 297 - protein, 223 aa, Bacillus caldolyticus DERA
MTMNIAKMIDHTLLKPEATEQQIVQLCTEAKQYGFAAVCVNPTWVKTAARELSGTDVRVCTVIGFPLGATTPETKAFETTNAIENGAREVDMVINIGALKSGQDELVERDIRAVVEAAAGRALVKVIVETALLTDEEKVRACQLAVKAGADYVKTSTGFSGGGATVEDVALMRKTVGDRAGVKASGGVRDWKTAEAMINAGATRIGTSSGVAIVTGGTGRADY

SEQ ID NO: 298 - protein, 223 aa, Bacillus caldolyticus C37N DERA
MTMNIAKMIDHTLLKPEATEQQIVQLCTEAKQYGFAAVNVNPTWVKTAARELSGTDVRVCTVIGFPLGATTPETKAFETTNAIENGAREVDMVINIGALKSGQDELVERDIRAVVEAAAGRALVKVIVETALLTDEEKVRACQLAVKAGADYVKTSTGFSGGGATVEDVALMRKTVGDRAGVKASGGVRDWKTAEAMINAGATRIGTSSGVAIVTGGTGRADY

SEQ ID NO: 299 - protein, 259 aa, Escherichia coli
MTDLKASSLRALKLMDLTTLNDDDTDEKVIALCHQAKTPVGNTAAINIYPRFIPIARKTLKEQGTPEIRIATVTNFPHGNDDIDIALAETRAAIAYGADEVDVVFPYRALMAGNEQVGFDLVKACKEACAAANVLLKVIIETGELKDEALIRKASEISIKAGADFIKTSTGKVAVNATPESARIMMEVIRDMGVEKTVGFKPAGGVRTAEDAQKYLAIADELFGADWADARHYRFGASSLLASLLKALGHGDGKSASSY

SEQ ID NO: 300 - protein, 220 aa, Escherichia coli
NIAKMIDHTLLKPEATEQQIVQLCTEAKQYGFAAVCVNPTWVKTAARELSGTDVRVCTVIGFPLGATTPETKAFETTNAIENGAREVDMVINIGALKSGQDELVERDIRAVVEAAAGRALVKVIVETALLTDEEKVRACQLAVKAGADYVKTSTGFSGGGATVEDVALMRKTVGDRAGVKASGGVRDWKTAEAMINAGATRIGTSSGVAIVTGGTGRADY

What is claimed is:

1. A recombinant microorganism overexpressing an enzyme having D-ribose-5-phosphate aldolase (DERA) activity,
    wherein said microorganism produces one or more pentose-phosphate intermediates from one or more pentose and/or hexose sugars, wherein the one or more pentose phosphate intermediates is selected from D-ribose-5-phosphate, D-ribulose-5-phosphate or D-xylulose-5-phosphate,
    wherein said enzyme converts the one or more pentose phosphate intermediates to glyceraldehyde-3-phosphate (G3P) and glycolaldehyde, and wherein said enzyme comprises an amino acid sequence having at least 95% sequence identity to the amino acid sequence of SEQ ID NO: 256 or SEQ ID NO: 297, and
    wherein said microorganism produces one or more products from the G3P and the glycolaldehyde, wherein the one or more products is selected from monoethylene glycol (MEG) and glycolic acid (GA).

2. The recombinant microorganism of claim 1, wherein the recombinant microorganism co-produces MEG or GA and one or more co-products, wherein the one or more co-products are selected from acetone, isopropanol, propene, L-serine, glycine, monoethanolamine (MEA), ethylenediamine, or a combination thereof.

3. The recombinant microorganism of claim 1, wherein the microorganism expresses at least one enzyme having transketolase activity, wherein the at least one enzyme having transketolase activity is encoded by a nucleotide sequence having at least 70% sequence identity to the nucleotide sequence of SEQ ID NO: 147 or SEQ ID NO: 149;
    the microorganism expresses at least one enzyme having transaldolase activity, wherein the at least one enzyme having transaldolase activity is encoded by a nucleotide sequence having at least 70% sequence identity to the nucleotide sequence of SEQ ID NO: 151 or SEQ ID NO: 153; and
    the microorganism expresses at least one enzyme having ribulose-5-phosphate 3-epimerase activity, wherein the at least one enzyme having ribulose-5-phosphate 3-epimerase activity is encoded by a nucleotide sequence having at least 70% sequence identity to the nucleotide sequence of SEQ ID NO: 157.

4. The recombinant microorganism of claim 1, wherein the enzyme having DERA activity comprises a cysteine to asparagine mutation at the position corresponding to position 47 of SEQ ID NO: 256.

5. The recombinant microorganism of claim 1, wherein the enzyme having DERA activity comprises the amino acid sequence of SEQ ID NO: 298.

6. The recombinant microorganism of claim 1, wherein the microorganism expresses at least one enzyme having ribose-5-phosphate isomerase activity, wherein the at least one enzyme having ribose-5-phosphate isomerase activity is encoded by a nucleotide sequence having at least 70% sequence identity to the nucleotide sequence of SEQ ID NO: 155 or SEQ ID NO: 253.

7. The recombinant microorganism of claim 1, wherein the recombinant microorganism further comprises a deleted or inactivated gene encoding one or more endogenous enzymes selected from glyceraldehyde 3-phosphate dehydrogenase, phosphoglycerate kinase and phosphoglycerate mutase, wherein the glyceraldehyde 3-phosphate dehydrogenase gene is gapA, the phosphoglycerate kinase gene is pgk and the phosphoglycerate mutase gene is gomA and/or gomM.

8. The recombinant microorganism of claim 1, wherein the microorganism expresses at least one enzyme having fructose-6-phosphate phosphoketolase activity, wherein the at least one enzyme having fructose-6-phosphate phosphoketolase activity is encoded by a nucleotide sequence having at least 70% sequence identity to the nucleotide sequence of SEQ ID NO: 211, SEQ ID NO: 213, SEQ ID NO: 215 or SEQ ID NO: 217; and
    the microorganism expresses at least one enzyme having phosphate acetyltransferase activity, wherein the at least one enzyme having phosphate acetyltransferase activity is encoded by a nucleotide sequence having at least 70% sequence identity to the nucleotide sequence of SEQ ID NO: 219 or SEQ ID NO: 221.

9. The recombinant microorganism of claim 1, wherein the recombinant microorganism further comprises a deleted or inactivated gene encoding an endogenous 6-phosphofructokinase enzyme, wherein the 6-phosphofructokinase gene is pfkA and/or pfkB; and
    wherein the recombinant microorganism further comprises a deleted or inactivated gene encoding one or more endogenous enzymes selected from glucose 6-phosphate-1-dehydrogenase, 6-phosphogluconolactonase, and 6-phosphogluconate dehydrogenase, wherein the glucose 6-phosphate-1-dehydrogenase gene is zwf, the 6-phosphogluconolactonase is pgl, and the 6-phosphogluconate dehydrogenase gene is gnd.

10. The recombinant microorganism of claim 1, wherein the one or more pentose and/or hexose sugars comprise D-xylose and the recombinant microorganism expresses at least one enzyme having xylose isomerase activity and expresses at least one enzyme having xylulose 5-kinase activity, wherein the at least one enzyme having xylose isomerase activity is encoded by a nucleotide sequence having at least 70% sequence identity to the nucleotide sequence of SEQ ID NO: 93, SEQ ID NO: 94, or SEQ ID NO: 143; and wherein the at least one enzyme having xylulose 5-kinase activity is encoded by a nucleotide sequence having at least 70% sequence identity to the nucleotide sequence of SEQ ID NO: 145.

11. The recombinant microorganism of claim 1, wherein the one or more pentose and/or hexose sugars comprise D-fructose and the recombinant microorganism expresses at least one enzyme having fructose 1,6-bisphosphatase activity.

12. The recombinant microorganism of claim 1, wherein the one or more pentose and/or hexose sugars comprise monomers, oligomers, or a combination thereof.

13. The recombinant microorganism of claim 1, wherein the recombinant microorganism expresses at least one enzyme having transketolase activity and/or fructose-6-phosphate phosphoketolase activity and expresses at least one enzyme having D-ribose 5-phosphate aldolase activity, wherein expression of the at least one enzyme having transketolase activity and/or fructose-6-phosphate phosphoketolase activity and the expression of the at least one enzyme having D-ribose 5-phosphate aldolase activity enables a lossless conversion of one or more pentose and/or hexose sugars to D-ribose-5-phosphate and the subsequent conversion of D-ribose-5-phosphate to G3P and glycolaldehyde.

14. The recombinant microorganism of claim 1, wherein MEG or GA is produced through the conversion of glycolaldehyde in a C2 pathway and through the conversion of G3P in one or more C3 pathways, wherein MEG is produced by the reduction of glycolaldehyde by an enzyme having glycolaldehyde reductase activity in the C2 pathway and wherein GA is produced by the oxidation of glycolaldehyde by an enzyme having glycolaldehyde dehydrogenase activity in the C2 pathway.

15. The recombinant microorganism of claim 14, wherein at least a portion of NADH produced in a C3 pathway is used as a source of reducing equivalents in a C2 pathway and wherein at least a portion of NADH produced in a C3 pathway is used to produce ATP.

16. A method of producing one or more products selected from MEG and GA, wherein the method comprises cultivating the recombinant microorganism of claim 1 in a culture medium containing one or more pentose and/or hexose sugars until the one or more products are produced.

17. A method of producing the recombinant microorganism of claim 1, comprising:
- expressing in the recombinant microorganism one or more enzymes for the conversion of the one or more pentose and/or hexose sugars to the one or more pentose-phosphate intermediates;
- overexpressing in the recombinant microorganism the enzyme having DERA activity for the conversion of the one or more pentose phosphate intermediates to G3P and glycolaldehyde;
- expressing in the recombinant microorganism one or more enzymes for the production of the one or more products from the G3P and the glycolaldehyde.

\* \* \* \* \*